United States Patent 11,254,933 (CRISPR/CAS TRANSCRIPTIONAL MODULATION) - sequence listing, part 19

SEQ ID NO: 829557 - DNA, 20 bp, mouse
gtctgcgaagagaaaaaggt

SEQ ID NO: 829558 - DNA, 20 bp, mouse
gtcactggccttcttagctg

SEQ ID NO: 829559 - DNA, 20 bp, mouse
gtgtaaatagaagaatctta

SEQ ID NO: 829560 - DNA, 20 bp, mouse
gtggccttcttagctgagga

SEQ ID NO: 829561 - DNA, 20 bp, mouse
gcctttctgcgaagagaaaa

SEQ ID NO: 829562 - DNA, 20 bp, mouse
gtgccggggtgggagggtta

SEQ ID NO: 829563 - DNA, 20 bp, mouse
ggtgagacacagtcctgctc

SEQ ID NO: 829564 - DNA, 20 bp, mouse
gtcagtttcatgttgaaagt

SEQ ID NO: 829565 - DNA, 20 bp, mouse
gggcaaaaacttttccacaa

SEQ ID NO: 829566 - DNA, 20 bp, mouse
gagcccaagcaggcacccac

SEQ ID NO: 829567 - DNA, 20 bp, mouse
gtccacgctccccagtgcca

SEQ ID NO: 829568 - DNA, 20 bp, mouse
gggagcagagtgctgagact

SEQ ID NO: 829569 - DNA, 20 bp, mouse
gtgacaaccagcatcgggtg

SEQ ID NO: 829570 - DNA, 20 bp, mouse
gaaccagcatcgggtgggga

SEQ ID NO: 829571 - DNA, 20 bp, mouse
ggccctggcactggggagcg

SEQ ID NO: 829572 - DNA, 20 bp, mouse
ggcagcctcttcattacaag

SEQ ID NO: 829573 - DNA, 20 bp, mouse
gacagcctcttgtaatgaag

SEQ ID NO: 829574 - DNA, 20 bp, mouse
gttagtggcccggtgtcaag

SEQ ID NO: 829575 - DNA, 20 bp, mouse
gttgggctccaggacgtgga

SEQ ID NO: 829576 - DNA, 20 bp, mouse
gggtggaaatacaactcggt

SEQ ID NO: 829577 - DNA, 20 bp, mouse
gctagtgaggccaaggggtg

SEQ ID NO: 829578 - DNA, 20 bp, mouse
gtatcctgaaaataccccag

SEQ ID NO: 829579 - DNA, 20 bp, mouse
gaaggggtgaggctgggcga

SEQ ID NO: 829580 - DNA, 20 bp, mouse
gacaactcggttggtaaagt

SEQ ID NO: 829581 - DNA, 20 bp, mouse
gggtgaggctgggcgaggga

SEQ ID NO: 829582 - DNA, 20 bp, mouse
ggtgcaaatcaaaccgggtg

SEQ ID NO: 829583 - DNA, 20 bp, mouse
gtggcaaagcagttcacgga

SEQ ID NO: 829584 - DNA, 20 bp, mouse
gaacaccctagtgaggccaa

SEQ ID NO: 829585 - DNA, 20 bp, mouse
gtaaactgtgcaaatcaaac

SEQ ID NO: 829586 - DNA, 20 bp, mouse
gctggaacataggaccagga

SEQ ID NO: 829587 - DNA, 20 bp, mouse
ggccaagcagagttcgggag

SEQ ID NO: 829588 - DNA, 20 bp, mouse
gaatggtgagggtgcgggca

SEQ ID NO: 829589 - DNA, 20 bp, mouse
gcggggcggggtttagttga

SEQ ID NO: 829590 - DNA, 20 bp, mouse
gctgaagcaactcaaggtta

SEQ ID NO: 829591 - DNA, 20 bp, mouse
ggagacctcccgctatttga

SEQ ID NO: 829592 - DNA, 20 bp, mouse
ggagggtgcgggcagggttg

SEQ ID NO: 829593 - DNA, 20 bp, mouse
gggggtggtgagaatggtga

SEQ ID NO: 829594 - DNA, 20 bp, mouse
gttagggaagccactagggc

SEQ ID NO: 829595 - DNA, 20 bp, mouse
gggacctggaacataggacc

SEQ ID NO: 829596 - DNA, 20 bp, mouse
gtacactatccaaaacgcct

SEQ ID NO: 829597 - DNA, 20 bp, mouse
gtcagccaatcgcatcgcta

SEQ ID NO: 829598 - DNA, 20 bp, mouse
ggcaatctgcgctggaaaca

SEQ ID NO: 829599 - DNA, 20 bp, mouse
gctggagcttggcttccgat

SEQ ID NO: 829600 - DNA, 20 bp, mouse
gagtgtagcttctggatgat

SEQ ID NO: 829601 - DNA, 20 bp, mouse
gcccaccctagcgatgcgat

SEQ ID NO: 829602 - DNA, 20 bp, mouse
gtccttgtcgatccgagccc

SEQ ID NO: 829603 - DNA, 20 bp, mouse
ggatccgagcccaggcgttt

SEQ ID NO: 829604 - DNA, 20 bp, mouse
ggcctgggctcggatcgaca

SEQ ID NO: 829605 - DNA, 20 bp, mouse
gtatccaaaacgcctgggct

SEQ ID NO: 829606 - DNA, 20 bp, mouse
gcgcccgcgggcttctggga

SEQ ID NO: 829607 - DNA, 20 bp, mouse
ggggcggctcggaaccccgt

SEQ ID NO: 829608 - DNA, 20 bp, mouse
gggaaacggcccagtcggga

SEQ ID NO: 829609 - DNA, 20 bp, mouse
gaacgcccgggccggaagca

SEQ ID NO: 829610 - DNA, 20 bp, mouse
gggaactacggatgccgagg

SEQ ID NO: 829611 - DNA, 20 bp, mouse
gcaaaatagcgcgcctggct

SEQ ID NO: 829612 - DNA, 20 bp, mouse
gcggaaccccgtcggtatca

SEQ ID NO: 829613 - DNA, 20 bp, mouse
ggaagactacgctgcagact

SEQ ID NO: 829614 - DNA, 20 bp, mouse
gagggaaaggaccgaggcgg

SEQ ID NO: 829615 - DNA, 20 bp, mouse
gtctgggagggaaaggaccg

SEQ ID NO: 829616 - DNA, 20 bp, mouse
gaccccaggcacagtcgcct

SEQ ID NO: 829617 - DNA, 20 bp, mouse
gcgcctgcgcagcgagagtc

SEQ ID NO: 829618 - DNA, 20 bp, mouse
gaactccaggcacttcccat

SEQ ID NO: 829619 - DNA, 20 bp, mouse
gcccaccggaaaagacaaga

SEQ ID NO: 829620 - DNA, 20 bp, mouse
gaaaagacaagagggacccc

SEQ ID NO: 829621 - DNA, 20 bp, mouse
gtcctcctggggcatcctgg

SEQ ID NO: 829622 - DNA, 20 bp, mouse
gcacgcagttgatcctcctg

SEQ ID NO: 829623 - DNA, 20 bp, mouse
gaggacttagagccacgacc

SEQ ID NO: 829624 - DNA, 20 bp, mouse
gccggtgggtgagcacatgc

SEQ ID NO: 829625 - DNA, 20 bp, mouse
gctggaggctgtaggttcta

SEQ ID NO: 829626 - DNA, 20 bp, mouse
gaaagggggcgcactcatgc

SEQ ID NO: 829627 - DNA, 20 bp, mouse
gcaaccactgaacttggccg

SEQ ID NO: 829628 - DNA, 20 bp, mouse
gcccgagaagcattctgtag

SEQ ID NO: 829629 - DNA, 20 bp, mouse
gccccagtctagaccacctg

SEQ ID NO: 829630 - DNA, 20 bp, mouse
gctagactggggcgaggttt

SEQ ID NO: 829631 - DNA, 20 bp, mouse
ggttccccggccaagttcag

SEQ ID NO: 829632 - DNA, 20 bp, mouse
gatgtgttggagtaacgaaa

SEQ ID NO: 829633 - DNA, 20 bp, mouse
gtgagctgggaatccccagg

SEQ ID NO: 829634 - DNA, 20 bp, mouse
gcaggaacaggcaaaacctt

SEQ ID NO: 829635 - DNA, 20 bp, mouse
gatgctggtgcatgaggacc

SEQ ID NO: 829636 - DNA, 20 bp, mouse
gcgtgccgctagcaaggtga

SEQ ID NO: 829637 - DNA, 20 bp, mouse
ggggccctgcggagttccct

SEQ ID NO: 829638 - DNA, 20 bp, mouse
gccgcagcccggttcggcag

SEQ ID NO: 829639 - DNA, 20 bp, mouse
ggcgcccagggaactccgca

SEQ ID NO: 829640 - DNA, 20 bp, mouse
gccttgctagcggcacgctc

SEQ ID NO: 829641 - DNA, 20 bp, mouse
gaatggcagcggggcagtgc

SEQ ID NO: 829642 - DNA, 20 bp, mouse
gccgcccctcaccttgctag

SEQ ID NO: 829643 - DNA, 20 bp, mouse
gctggctgcgaaggtgcgtg

SEQ ID NO: 829644 - DNA, 20 bp, mouse
gtatgggtctgctcttcagc

SEQ ID NO: 829645 - DNA, 20 bp, mouse
gcggcacgctctggctgcga

SEQ ID NO: 829646 - DNA, 20 bp, mouse
gccgctggaccccgcagagt

SEQ ID NO: 829647 - DNA, 20 bp, mouse
gaccccgcagagtgggcgga

SEQ ID NO: 829648 - DNA, 20 bp, mouse
gagcgcgcatcgcaggtgac

SEQ ID NO: 829649 - DNA, 20 bp, mouse
gcccgcaagctcatcccgcg

SEQ ID NO: 829650 - DNA, 20 bp, mouse
ggccccgcgggatgagcttg

SEQ ID NO: 829651 - DNA, 20 bp, mouse
ggggtccagcggcggagcct

SEQ ID NO: 829652 - DNA, 20 bp, mouse
gagagtgggcggagggatgc

SEQ ID NO: 829653 - DNA, 20 bp, mouse
gagcctcggcgctgggacag

SEQ ID NO: 829654 - DNA, 20 bp, mouse
gagctcatcccgcggggctg

SEQ ID NO: 829655 - DNA, 20 bp, mouse
gcgctcgcccgcttccctcg

SEQ ID NO: 829656 - DNA, 20 bp, mouse
gggtccgtcacaatccccga

SEQ ID NO: 829657 - DNA, 20 bp, mouse
ggagccttcggggattgtga

SEQ ID NO: 829658 - DNA, 20 bp, mouse
gtgcttcatttcactgaatt

SEQ ID NO: 829659 - DNA, 20 bp, mouse
ggacggacctgccctaacag

SEQ ID NO: 829660 - DNA, 20 bp, mouse
gcagcaaggtgagaccgacc

SEQ ID NO: 829661 - DNA, 20 bp, mouse
ggaaaagagagagcacgctt

SEQ ID NO: 829662 - DNA, 20 bp, mouse
gcatcaaagcaacctctgtt

SEQ ID NO: 829663 - DNA, 20 bp, mouse
ggccagtgatgccaacattc

SEQ ID NO: 829664 - DNA, 20 bp, mouse
gaagcaacctctgttagggc

SEQ ID NO: 829665 - DNA, 20 bp, mouse
gagacaaagacacgtatctt

SEQ ID NO: 829666 - DNA, 20 bp, mouse
gtcgcggcggaatggagtga

SEQ ID NO: 829667 - DNA, 20 bp, mouse
ggcgtcctgccacctcgcgg

SEQ ID NO: 829668 - DNA, 20 bp, mouse
gcgaggtggcaggacgctca

SEQ ID NO: 829669 - DNA, 20 bp, mouse
ggatgccaggagacctctgc

SEQ ID NO: 829670 - DNA, 20 bp, mouse
gccgtataagggaatcgttc

SEQ ID NO: 829671 - DNA, 20 bp, mouse
gtagggttgcgtgacgtcac

SEQ ID NO: 829672 - DNA, 20 bp, mouse
gaggtagccaatcgtcgcta

SEQ ID NO: 829673 - DNA, 20 bp, mouse
gcgtcactggatcccggcag

SEQ ID NO: 829674 - DNA, 20 bp, mouse
gctgccacctcgcggcggaa

SEQ ID NO: 829675 - DNA, 20 bp, mouse
gtaagggaatcgttcaggtt

SEQ ID NO: 829676 - DNA, 20 bp, mouse
gggaatgccacgtggtacga

SEQ ID NO: 829677 - DNA, 20 bp, mouse
ggagttgcccaattaacgtt

SEQ ID NO: 829678 - DNA, 20 bp, mouse
ggtacgagggtgggcacaat

SEQ ID NO: 829679 - DNA, 20 bp, mouse
gtcaaaggttgacgattgat

SEQ ID NO: 829680 - DNA, 20 bp, mouse
gcccggaggcggatcaccgc

SEQ ID NO: 829681 - DNA, 20 bp, mouse
gatgccacgtggtacgaggg

SEQ ID NO: 829682 - DNA, 20 bp, mouse
gctattagctcgtttgtcaa

SEQ ID NO: 829683 - DNA, 20 bp, mouse
ggaagatgaagggaaccaat

SEQ ID NO: 829684 - DNA, 20 bp, mouse
gggcattcctaacgttaatt

SEQ ID NO: 829685 - DNA, 20 bp, mouse
gggcgccgagcgttgctgat

SEQ ID NO: 829686 - DNA, 20 bp, mouse
gagcagccatttcaggggat

SEQ ID NO: 829687 - DNA, 20 bp, mouse
gacatcctctgctctagctt

SEQ ID NO: 829688 - DNA, 20 bp, mouse
ggctctgcctgtaagcttat

SEQ ID NO: 829689 - DNA, 20 bp, mouse
gctatcacccataagcttac

SEQ ID NO: 829690 - DNA, 20 bp, mouse
ggtattgcccactagacaat

SEQ ID NO: 829691 - DNA, 20 bp, mouse
ggtctcctaagctagagcag

SEQ ID NO: 829692 - DNA, 20 bp, mouse
gccagattcccattgtctag

SEQ ID NO: 829693 - DNA, 20 bp, mouse
ggtgggcaatacccctccct

SEQ ID NO: 829694 - DNA, 20 bp, mouse
gcgctgcaagcagccatttc

SEQ ID NO: 829695 - DNA, 20 bp, mouse
gcagttttttacacctaggg

SEQ ID NO: 829696 - DNA, 20 bp, mouse
ggtcgccaccatcggatcga

SEQ ID NO: 829697 - DNA, 20 bp, mouse
gtcctccatcgatccgatgg

SEQ ID NO: 829698 - DNA, 20 bp, mouse
ggactcctccatcgatccga

SEQ ID NO: 829699 - DNA, 20 bp, mouse
ggatccgatggtggcgacct

SEQ ID NO: 829700 - DNA, 20 bp, mouse
gcacccagaggttcctgcta

SEQ ID NO: 829701 - DNA, 20 bp, mouse
gaagcctcctgtgatttcgg

SEQ ID NO: 829702 - DNA, 20 bp, mouse
gctcccttagcaggaacctc

SEQ ID NO: 829703 - DNA, 20 bp, mouse
ggggcaggtcggcgcaggga

SEQ ID NO: 829704 - DNA, 20 bp, mouse
gccgccaccgaaatcacagg

SEQ ID NO: 829705 - DNA, 20 bp, mouse
gtcccccaggtcgccaccat

SEQ ID NO: 829706 - DNA, 20 bp, mouse
ggacgtgactggcatgcgag

SEQ ID NO: 829707 - DNA, 20 bp, mouse
gggcacccggggctcaggaa

SEQ ID NO: 829708 - DNA, 20 bp, mouse
gcggcccccgcgggagacag

SEQ ID NO: 829709 - DNA, 20 bp, mouse
ggactggcatgcgagcggag

SEQ ID NO: 829710 - DNA, 20 bp, mouse
gactcgccgcgcccccgcga

SEQ ID NO: 829711 - DNA, 20 bp, mouse
ggctctcaggcggccgccga

SEQ ID NO: 829712 - DNA, 20 bp, mouse
gcggccgcacacccacgcgt

SEQ ID NO: 829713 - DNA, 20 bp, mouse
gtctctaggctcggcggggc

SEQ ID NO: 829714 - DNA, 20 bp, mouse
gggcggggccggctctcagg

SEQ ID NO: 829715 - DNA, 20 bp, mouse
gggctcaggaaaggccgggg

SEQ ID NO: 829716 - DNA, 20 bp, mouse
ggaagcagcccttgtggcga

SEQ ID NO: 829717 - DNA, 20 bp, mouse
gcaggcaggccggggatccc

SEQ ID NO: 829718 - DNA, 20 bp, mouse
gtgcaactggagtacggcga

SEQ ID NO: 829719 - DNA, 20 bp, mouse
ggagggagccatcgccacaa

SEQ ID NO: 829720 - DNA, 20 bp, mouse
ggcacccgctagaactgcag

SEQ ID NO: 829721 - DNA, 20 bp, mouse
gctgcccagcagccaggcag

SEQ ID NO: 829722 - DNA, 20 bp, mouse
gccgccaggctggtgtgcaa

SEQ ID NO: 829723 - DNA, 20 bp, mouse
ggagggtgccccgggatccc

SEQ ID NO: 829724 - DNA, 20 bp, mouse
gctgctgggcaggtccttgg

SEQ ID NO: 829725 - DNA, 20 bp, mouse
ggtggggagcggcagtatgt

SEQ ID NO: 829726 - DNA, 20 bp, mouse
ggggctgcgccggaagctgg

SEQ ID NO: 829727 - DNA, 20 bp, mouse
gccggcgcagcccctcttag

SEQ ID NO: 829728 - DNA, 20 bp, mouse
ggggtccagcaagccgagtc

SEQ ID NO: 829729 - DNA, 20 bp, mouse
gaagaactgaagtccttggg

SEQ ID NO: 829730 - DNA, 20 bp, mouse
ggcgcagcccctcttagagg

SEQ ID NO: 829731 - DNA, 20 bp, mouse
gcaaatctggacccgccctc

SEQ ID NO: 829732 - DNA, 20 bp, mouse
gtggctggttacagcttgaa

SEQ ID NO: 829733 - DNA, 20 bp, mouse
gggggcgtggcgtgcaaatc

SEQ ID NO: 829734 - DNA, 20 bp, mouse
gtgcgcgcgattgcgacctg

SEQ ID NO: 829735 - DNA, 20 bp, mouse
gcgccacgccccctctaaga

SEQ ID NO: 829736 - DNA, 20 bp, mouse
gcccgctcccacatacactc

SEQ ID NO: 829737 - DNA, 20 bp, mouse
ggcccctggccgttgctacc

SEQ ID NO: 829738 - DNA, 20 bp, mouse
gggccagtgattggcttctc

SEQ ID NO: 829739 - DNA, 20 bp, mouse
gtgctacccggagtgtatgt

SEQ ID NO: 829740 - DNA, 20 bp, mouse
gactccgggtagcaacggcc

SEQ ID NO: 829741 - DNA, 20 bp, mouse
gactcattgcatggcctgat

SEQ ID NO: 829742 - DNA, 20 bp, mouse
gttactatttagagcggtgg

SEQ ID NO: 829743 - DNA, 20 bp, mouse
gaggatactcgaggtctcat

SEQ ID NO: 829744 - DNA, 20 bp, mouse
gagcctggacaggatactcg

SEQ ID NO: 829745 - DNA, 20 bp, mouse
gaggcggggccagcctggac

SEQ ID NO: 829746 - DNA, 20 bp, mouse
gaaaccgcatccaagaacga

SEQ ID NO: 829747 - DNA, 20 bp, mouse
gtgtctgcacgacgagggcg

SEQ ID NO: 829748 - DNA, 20 bp, mouse
gcgtgcaagagcgggaaaga

SEQ ID NO: 829749 - DNA, 20 bp, mouse
gtccaagaacgaggggccga

SEQ ID NO: 829750 - DNA, 20 bp, mouse
gtcagtgactgttagcggaa

SEQ ID NO: 829751 - DNA, 20 bp, mouse
gggcccctcgttcttggatg

SEQ ID NO: 829752 - DNA, 20 bp, mouse
gcggaaaggcgtgcaagagc

SEQ ID NO: 829753 - DNA, 20 bp, mouse
gcccatcggcccctcgttct

SEQ ID NO: 829754 - DNA, 20 bp, mouse
gccgctaacagtcactgaat

SEQ ID NO: 829755 - DNA, 20 bp, mouse
gactctcgtgcgcatcccat

SEQ ID NO: 829756 - DNA, 20 bp, mouse
gtcaaagcgggtctttggga

SEQ ID NO: 829757 - DNA, 20 bp, mouse
ggaaaaaggcgggaagtaaa

SEQ ID NO: 829758 - DNA, 20 bp, mouse
gtaaagggaagtgccgctat

SEQ ID NO: 829759 - DNA, 20 bp, mouse
gggctcgcgcgctgcctact

SEQ ID NO: 829760 - DNA, 20 bp, mouse
gaaggagagaagtgttgctc

SEQ ID NO: 829761 - DNA, 20 bp, mouse
gggggccgatcagcctatag

SEQ ID NO: 829762 - DNA, 20 bp, mouse
gtccaacttctccacagtgt

SEQ ID NO: 829763 - DNA, 20 bp, mouse
ggccccgcgagactgtcacg

SEQ ID NO: 829764 - DNA, 20 bp, mouse
gtcgaagattccaagttggg

SEQ ID NO: 829765 - DNA, 20 bp, mouse
gcgagtgagcggctcccagt

SEQ ID NO: 829766 - DNA, 20 bp, mouse
ggggacaaaccactatactt

SEQ ID NO: 829767 - DNA, 20 bp, mouse
ggggggcgtgagaggatgtc

SEQ ID NO: 829768 - DNA, 20 bp, mouse
ggtgagaggatgtcaggtgt

SEQ ID NO: 829769 - DNA, 20 bp, mouse
gggtacccggtttgtatggc

SEQ ID NO: 829770 - DNA, 20 bp, mouse
gaggactggcaaggggggcg

SEQ ID NO: 829771 - DNA, 20 bp, mouse
gatacttgggggtatgtctt

SEQ ID NO: 829772 - DNA, 20 bp, mouse
ggtctcgcgaggtttactct

SEQ ID NO: 829773 - DNA, 20 bp, mouse
gggaagagggcatagtctca

SEQ ID NO: 829774 - DNA, 20 bp, mouse
gggagagctttggtagtgaa

SEQ ID NO: 829775 - DNA, 20 bp, mouse
gccaacttccaggactggca

SEQ ID NO: 829776 - DNA, 20 bp, mouse
gcctgcctaccatgcttcaa

SEQ ID NO: 829777 - DNA, 20 bp, mouse
gtctttgcacgggtgttagg

SEQ ID NO: 829778 - DNA, 20 bp, mouse
gggtaggcaggtctttgcac

SEQ ID NO: 829779 - DNA, 20 bp, mouse
gttctcccttgaagcatggt

SEQ ID NO: 829780 - DNA, 20 bp, mouse
gctctgatcaagaactggaa

SEQ ID NO: 829781 - DNA, 20 bp, mouse
gacctcctctgatcaagaac

SEQ ID NO: 829782 - DNA, 20 bp, mouse
gccagactgtgaaagtagta

SEQ ID NO: 829783 - DNA, 20 bp, mouse
gcattatgacataatagttg

SEQ ID NO: 829784 - DNA, 20 bp, mouse
ggaaggtctccatacctcct

SEQ ID NO: 829785 - DNA, 20 bp, mouse
gactttcacagtctggaagt

SEQ ID NO: 829786 - DNA, 20 bp, mouse
gcgcagccccccaaagtggg

SEQ ID NO: 829787 - DNA, 20 bp, mouse
gggcccacaatcccccgcga

SEQ ID NO: 829788 - DNA, 20 bp, mouse
ggcgagggcgggaaaagcaa

SEQ ID NO: 829789 - DNA, 20 bp, mouse
gtaccgcagccccccaaagt

SEQ ID NO: 829790 - DNA, 20 bp, mouse
gggccagcctcccactttgg

SEQ ID NO: 829791 - DNA, 20 bp, mouse
gccacaatcccccgcgaggg

SEQ ID NO: 829792 - DNA, 20 bp, mouse
gtctactacaacttccatcc

SEQ ID NO: 829793 - DNA, 20 bp, mouse
gcgcacgcacagcttccggt

SEQ ID NO: 829794 - DNA, 20 bp, mouse
gagtgcgtggacgcgcgcgt

SEQ ID NO: 829795 - DNA, 20 bp, mouse
ggtgggccagcctcccactt

SEQ ID NO: 829796 - DNA, 20 bp, mouse
gaagggtgcttactatgcta

SEQ ID NO: 829797 - DNA, 20 bp, mouse
gcagtcttcattacttccaa

SEQ ID NO: 829798 - DNA, 20 bp, mouse
gaaaacttatcccaagcgtg

SEQ ID NO: 829799 - DNA, 20 bp, mouse
ggcagtcaagttgctagact

SEQ ID NO: 829800 - DNA, 20 bp, mouse
ggaagtagaatggttagcct

SEQ ID NO: 829801 - DNA, 20 bp, mouse
gaagaagagatgatcatcat

SEQ ID NO: 829802 - DNA, 20 bp, mouse
gtctatagagctgggggcaa

SEQ ID NO: 829803 - DNA, 20 bp, mouse
gctaaggttacatagcaaca

SEQ ID NO: 829804 - DNA, 20 bp, mouse
gacattttagccacacgctt

SEQ ID NO: 829805 - DNA, 20 bp, mouse
gccttagttggtctggtact

SEQ ID NO: 829806 - DNA, 20 bp, mouse
gagactgaatctagctgata

SEQ ID NO: 829807 - DNA, 20 bp, mouse
gactctggatcagtaacatt

SEQ ID NO: 829808 - DNA, 20 bp, mouse
gttgaagacttgaccaagac

SEQ ID NO: 829809 - DNA, 20 bp, mouse
gtgaaacattggatgacctc

SEQ ID NO: 829810 - DNA, 20 bp, mouse
gaacagtaccagatggaatc

SEQ ID NO: 829811 - DNA, 20 bp, mouse
ggtactgttcaattctcagc

SEQ ID NO: 829812 - DNA, 20 bp, mouse
gtgactcagaaaagtctcca

SEQ ID NO: 829813 - DNA, 20 bp, mouse
gagaattgaacagtaccaga

SEQ ID NO: 829814 - DNA, 20 bp, mouse
gtcaggttcagaaaagtccc

SEQ ID NO: 829815 - DNA, 20 bp, mouse
gatctggagctctgaaacat

SEQ ID NO: 829816 - DNA, 20 bp, mouse
ggggcactcaggtggcgcaa

SEQ ID NO: 829817 - DNA, 20 bp, mouse
gaaggcccgggctcagagtt

SEQ ID NO: 829818 - DNA, 20 bp, mouse
gggctctgaaggcgcacatg

SEQ ID NO: 829819 - DNA, 20 bp, mouse
gtgaaggcgcacatgcggcc

SEQ ID NO: 829820 - DNA, 20 bp, mouse
gttcagagccagagtgactc

SEQ ID NO: 829821 - DNA, 20 bp, mouse
gcgggcccaactctgagccc

SEQ ID NO: 829822 - DNA, 20 bp, mouse
gtagacaggcaactgtgctt

SEQ ID NO: 829823 - DNA, 20 bp, mouse
gaacaaaaagacccatagac

SEQ ID NO: 829824 - DNA, 20 bp, mouse
gcgggacttggccctttata

SEQ ID NO: 829825 - DNA, 20 bp, mouse
gttaaagaaattctttgtag

SEQ ID NO: 829826 - DNA, 20 bp, mouse
gcgcatgcgctgctcccctg

SEQ ID NO: 829827 - DNA, 20 bp, mouse
gagggtgctcaggtgtccgc

SEQ ID NO: 829828 - DNA, 20 bp, mouse
gggcccccaaggtgcacatg

SEQ ID NO: 829829 - DNA, 20 bp, mouse
gaggcctcatgtgcaccttg

SEQ ID NO: 829830 - DNA, 20 bp, mouse
gtgagtcactctggccccca

SEQ ID NO: 829831 - DNA, 20 bp, mouse
gtgagtcccagactcctcta

SEQ ID NO: 829832 - DNA, 20 bp, mouse
gaagcacagttgcccctctc

SEQ ID NO: 829833 - DNA, 20 bp, mouse
gggtcaaggttgagctccag

SEQ ID NO: 829834 - DNA, 20 bp, mouse
gctcaaccttgaccacacag

SEQ ID NO: 829835 - DNA, 20 bp, mouse
gtcgctcagttctcaactgc

SEQ ID NO: 829836 - DNA, 20 bp, mouse
ggatcctccaggcccgtcgc

SEQ ID NO: 829837 - DNA, 20 bp, mouse
gagtgccgcgcgcccgcgac

SEQ ID NO: 829838 - DNA, 20 bp, mouse
gaacagccctgaccgatcgc

SEQ ID NO: 829839 - DNA, 20 bp, mouse
gtaaaggggctgcggcgctg

SEQ ID NO: 829840 - DNA, 20 bp, mouse
gtcggtcagggctgttaaag

SEQ ID NO: 829841 - DNA, 20 bp, mouse
ggggaggccgcgaaaaactg

SEQ ID NO: 829842 - DNA, 20 bp, mouse
gaaagcgcctcagtttcaat

SEQ ID NO: 829843 - DNA, 20 bp, mouse
gttacctggcagaatcccag

SEQ ID NO: 829844 - DNA, 20 bp, mouse
gtggctggattggtcatgtc

SEQ ID NO: 829845 - DNA, 20 bp, mouse
gtctggctaggcagattctt

SEQ ID NO: 829846 - DNA, 20 bp, mouse
gaacgcgacacagacagcaa

SEQ ID NO: 829847 - DNA, 20 bp, mouse
gagtgttcgttcacttgggt

SEQ ID NO: 829848 - DNA, 20 bp, mouse
gcaaacgtgaaaatcctgtt

SEQ ID NO: 829849 - DNA, 20 bp, mouse
gggaagacagagacatctca

SEQ ID NO: 829850 - DNA, 20 bp, mouse
gtgatagtgttcgttcactt

SEQ ID NO: 829851 - DNA, 20 bp, mouse
gtgtcgcgttcacctagcaa

SEQ ID NO: 829852 - DNA, 20 bp, mouse
gttcacaaacgcctccaaac

SEQ ID NO: 829853 - DNA, 20 bp, mouse
gcactttcaccagatattag

SEQ ID NO: 829854 - DNA, 20 bp, mouse
gatccctaagaggatagaaa

SEQ ID NO: 829855 - DNA, 20 bp, mouse
gaaaacttctgatccctaag

SEQ ID NO: 829856 - DNA, 20 bp, mouse
gtaaacagagctggctggtg

SEQ ID NO: 829857 - DNA, 20 bp, mouse
gaggggggcttaatgagctc

SEQ ID NO: 829858 - DNA, 20 bp, mouse
gtaggctccgggacagatga

SEQ ID NO: 829859 - DNA, 20 bp, mouse
gcagggagtggagggtcgtg

SEQ ID NO: 829860 - DNA, 20 bp, mouse
ggggtccaggtaaacagagc

SEQ ID NO: 829861 - DNA, 20 bp, mouse
ggctggggcgcacgcgtgga

SEQ ID NO: 829862 - DNA, 20 bp, mouse
ggatgcagagctcgcccaga

SEQ ID NO: 829863 - DNA, 20 bp, mouse
ggacccacatgagcgttcac

SEQ ID NO: 829864 - DNA, 20 bp, mouse
ggctccgggacagatgaggg

SEQ ID NO: 829865 - DNA, 20 bp, mouse
gtggatcagccggtgagccc

SEQ ID NO: 829866 - DNA, 20 bp, mouse
gtagggaaaccatccataga

SEQ ID NO: 829867 - DNA, 20 bp, mouse
ggtccccttccatctatgga

SEQ ID NO: 829868 - DNA, 20 bp, mouse
gtgcaatgggtgtggctaga

SEQ ID NO: 829869 - DNA, 20 bp, mouse
gtgataaggagctgtgaaac

SEQ ID NO: 829870 - DNA, 20 bp, mouse
gctttgtgatgcaatgggtg

SEQ ID NO: 829871 - DNA, 20 bp, mouse
gttaagaatggcaacatcta

SEQ ID NO: 829872 - DNA, 20 bp, mouse
ggggacaggcatgttaggag

SEQ ID NO: 829873 - DNA, 20 bp, mouse
gggtgtggctagagggaaga

SEQ ID NO: 829874 - DNA, 20 bp, mouse
ggggaagatggctgccactc

SEQ ID NO: 829875 - DNA, 20 bp, mouse
gaggtctctagagacttaga

SEQ ID NO: 829876 - DNA, 20 bp, mouse
gccaaggagtcgtagtccat

SEQ ID NO: 829877 - DNA, 20 bp, mouse
ggctcaccctctgggtccag

SEQ ID NO: 829878 - DNA, 20 bp, mouse
gggttgagaactattggatt

SEQ ID NO: 829879 - DNA, 20 bp, mouse
gaaggcacgcgcagagggtg

SEQ ID NO: 829880 - DNA, 20 bp, mouse
gctccgcccctggacccaga

SEQ ID NO: 829881 - DNA, 20 bp, mouse
gactacgactccttgggggt

SEQ ID NO: 829882 - DNA, 20 bp, mouse
gcgtgatgcgctcaccctct

SEQ ID NO: 829883 - DNA, 20 bp, mouse
gtcacaaaggcacgcgcaga

SEQ ID NO: 829884 - DNA, 20 bp, mouse
gcctttgtgaagcgtcgcta

SEQ ID NO: 829885 - DNA, 20 bp, mouse
gtgtcgaacgaacttttcac

SEQ ID NO: 829886 - DNA, 20 bp, mouse
gcgagcgccgctaaccggct

SEQ ID NO: 829887 - DNA, 20 bp, mouse
gcagcctagagggagagtta

SEQ ID NO: 829888 - DNA, 20 bp, mouse
gaatcgcgctgcacccggta

SEQ ID NO: 829889 - DNA, 20 bp, mouse
ggcccgcgagcgccgctaac

SEQ ID NO: 829890 - DNA, 20 bp, mouse
ggattggttccaatcaatct

SEQ ID NO: 829891 - DNA, 20 bp, mouse
gatccaaggctgtgcggagc

SEQ ID NO: 829892 - DNA, 20 bp, mouse
gtgcggagcaggcttgagcc

SEQ ID NO: 829893 - DNA, 20 bp, mouse
ggcgccgctaaccggctcgg

SEQ ID NO: 829894 - DNA, 20 bp, mouse
gagcaggcttgagccaggat

SEQ ID NO: 829895 - DNA, 20 bp, mouse
gcccagaaaattaggatcca

SEQ ID NO: 829896 - DNA, 20 bp, mouse
ggtatcctggccgacaggga

SEQ ID NO: 829897 - DNA, 20 bp, mouse
gaaggcgcaggggtgaaggc

SEQ ID NO: 829898 - DNA, 20 bp, mouse
gccccccccccagctgggtt

SEQ ID NO: 829899 - DNA, 20 bp, mouse
gtgggcccaacccagctggg

SEQ ID NO: 829900 - DNA, 20 bp, mouse
gcgtgcgctccagatttgga

SEQ ID NO: 829901 - DNA, 20 bp, mouse
gctgccccgccccgtctcct

SEQ ID NO: 829902 - DNA, 20 bp, mouse
ggcttctggagcaggcaaac

SEQ ID NO: 829903 - DNA, 20 bp, mouse
ggataccttggggtattggt

SEQ ID NO: 829904 - DNA, 20 bp, mouse
gggcgcgtgcgctccagatt

SEQ ID NO: 829905 - DNA, 20 bp, mouse
gttgagaaggttctgaggga

SEQ ID NO: 829906 - DNA, 20 bp, mouse
gccctagcatggaaaaggat

SEQ ID NO: 829907 - DNA, 20 bp, mouse
gggacccagggcctcatatg

SEQ ID NO: 829908 - DNA, 20 bp, mouse
gcttttcagcacaactagag

SEQ ID NO: 829909 - DNA, 20 bp, mouse
ggactttagtataaaattct

SEQ ID NO: 829910 - DNA, 20 bp, mouse
gtgggaaagaaattagaggt

SEQ ID NO: 829911 - DNA, 20 bp, mouse
gtaatgcacttgaagcttga

SEQ ID NO: 829912 - DNA, 20 bp, mouse
ggcaagttttacctcatatg

SEQ ID NO: 829913 - DNA, 20 bp, mouse
gtccctgtgcattcatagtt

SEQ ID NO: 829914 - DNA, 20 bp, mouse
gtgcattcatagttaggatt

SEQ ID NO: 829915 - DNA, 20 bp, mouse
gaaagtcattttctatgata

SEQ ID NO: 829916 - DNA, 20 bp, mouse
ggggggccaagcacactaat

SEQ ID NO: 829917 - DNA, 20 bp, mouse
ggggaaatctcccctgtgta

SEQ ID NO: 829918 - DNA, 20 bp, mouse
gcagaacagtaccttacaca

SEQ ID NO: 829919 - DNA, 20 bp, mouse
gtacctcagcttcttgtcta

SEQ ID NO: 829920 - DNA, 20 bp, mouse
ggcagaaggggcccactctg

SEQ ID NO: 829921 - DNA, 20 bp, mouse
ggcacctcattctatggact

SEQ ID NO: 829922 - DNA, 20 bp, mouse
gtacacagcacctcattcta

SEQ ID NO: 829923 - DNA, 20 bp, mouse
gctgaaagcgtggtgagctt

SEQ ID NO: 829924 - DNA, 20 bp, mouse
gatggactgggtatggagag

SEQ ID NO: 829925 - DNA, 20 bp, mouse
gtggaggcataggactcaca

SEQ ID NO: 829926 - DNA, 20 bp, mouse
gccggccggcagctcctcgg

SEQ ID NO: 829927 - DNA, 20 bp, mouse
ggcttcgcccggggctcgtg

SEQ ID NO: 829928 - DNA, 20 bp, mouse
gggaccgccgagccgagcgc

SEQ ID NO: 829929 - DNA, 20 bp, mouse
ggtgaggaaagaagttgtca

SEQ ID NO: 829930 - DNA, 20 bp, mouse
ggcgtggccgagctaaaagc

SEQ ID NO: 829931 - DNA, 20 bp, mouse
gcgcacgcaggcttcgcccg

SEQ ID NO: 829932 - DNA, 20 bp, mouse
gctcgcgggcgcctggaggc

SEQ ID NO: 829933 - DNA, 20 bp, mouse
gtccctgaagagagtgaggg

SEQ ID NO: 829934 - DNA, 20 bp, mouse
ggaggctggactcctgaagc

SEQ ID NO: 829935 - DNA, 20 bp, mouse
gcggcaaaacagaccgtcgg

SEQ ID NO: 829936 - DNA, 20 bp, mouse
gtctgtctagggaaaggtgg

SEQ ID NO: 829937 - DNA, 20 bp, mouse
ggggctcagatcaagcataa

SEQ ID NO: 829938 - DNA, 20 bp, mouse
gtatccatgtgccaggttca

SEQ ID NO: 829939 - DNA, 20 bp, mouse
gcagagtaacaaagtatctt

SEQ ID NO: 829940 - DNA, 20 bp, mouse
ggccaagattgaaagcacag

SEQ ID NO: 829941 - DNA, 20 bp, mouse
gcctgggcatagtgtcgcca

SEQ ID NO: 829942 - DNA, 20 bp, mouse
gacatgaccaactctgtcta

SEQ ID NO: 829943 - DNA, 20 bp, mouse
gtgctggatggtgggaatca

SEQ ID NO: 829944 - DNA, 20 bp, mouse
gctcagaaataaccattgag

SEQ ID NO: 829945 - DNA, 20 bp, mouse
gaaccattgagcggccacca

SEQ ID NO: 829946 - DNA, 20 bp, mouse
gctgttgcccctgagatcaa

SEQ ID NO: 829947 - DNA, 20 bp, mouse
gcttaagcctaggaatgctg

SEQ ID NO: 829948 - DNA, 20 bp, mouse
gcgagagtgttgctagctat

SEQ ID NO: 829949 - DNA, 20 bp, mouse
ggccaaaaggccttaagcct

SEQ ID NO: 829950 - DNA, 20 bp, mouse
gacagctgaggtcacaatgc

SEQ ID NO: 829951 - DNA, 20 bp, mouse
gggtaagagcctttgatctc

SEQ ID NO: 829952 - DNA, 20 bp, mouse
gttgaccacctctttgtgtg

SEQ ID NO: 829953 - DNA, 20 bp, mouse
gaccaggttccaaagccaaa

SEQ ID NO: 829954 - DNA, 20 bp, mouse
ggcttaaggccttttggctt

SEQ ID NO: 829955 - DNA, 20 bp, mouse
gtttgtgtgcggaacagctg

SEQ ID NO: 829956 - DNA, 20 bp, mouse
ggtcccaaaaccagcctgag

SEQ ID NO: 829957 - DNA, 20 bp, mouse
gcaggcaggtgagtgagtcc

SEQ ID NO: 829958 - DNA, 20 bp, mouse
gtagctccagagcagtactc

SEQ ID NO: 829959 - DNA, 20 bp, mouse
ggacaatgctgaatccatga

SEQ ID NO: 829960 - DNA, 20 bp, mouse
gagaaagcccaccactatca

SEQ ID NO: 829961 - DNA, 20 bp, mouse
gcacctctcaggctggtttt

SEQ ID NO: 829962 - DNA, 20 bp, mouse
gtagaattctgcacgtgctt

SEQ ID NO: 829963 - DNA, 20 bp, mouse
gatggcaaaaccccctcttg

SEQ ID NO: 829964 - DNA, 20 bp, mouse
gcaaacattttgcaccctca

SEQ ID NO: 829965 - DNA, 20 bp, mouse
gggattcagcattgtcctca

SEQ ID NO: 829966 - DNA, 20 bp, mouse
gctcccggaggggtaagaca

SEQ ID NO: 829967 - DNA, 20 bp, mouse
gaactggatcagaataaacc

SEQ ID NO: 829968 - DNA, 20 bp, mouse
gggatagggcaactgacatg

SEQ ID NO: 829969 - DNA, 20 bp, mouse
ggaggggtaagacagggata

SEQ ID NO: 829970 - DNA, 20 bp, mouse
gtcaggacatctggaccaac

SEQ ID NO: 829971 - DNA, 20 bp, mouse
ggctgactgtatgacaccag

SEQ ID NO: 829972 - DNA, 20 bp, mouse
gtgtcctgagactcccggag

SEQ ID NO: 829973 - DNA, 20 bp, mouse
gtggaaacctgccagggcat

SEQ ID NO: 829974 - DNA, 20 bp, mouse
gtaggtcagggctggtctca

SEQ ID NO: 829975 - DNA, 20 bp, mouse
gccgggagtctcaggacatc

SEQ ID NO: 829976 - DNA, 20 bp, mouse
gtgtcctggggctgctctat

SEQ ID NO: 829977 - DNA, 20 bp, mouse
ggtactagaggttactggat

SEQ ID NO: 829978 - DNA, 20 bp, mouse
gggctcacaaacattgtccc

SEQ ID NO: 829979 - DNA, 20 bp, mouse
gggagagcacacagagcatt

SEQ ID NO: 829980 - DNA, 20 bp, mouse
gagggccttggcattctcaa

SEQ ID NO: 829981 - DNA, 20 bp, mouse
gattgggcagacaactcttc

SEQ ID NO: 829982 - DNA, 20 bp, mouse
gcttctggtgcctcggtctt

SEQ ID NO: 829983 - DNA, 20 bp, mouse
gtggtcctgcatccctttcc

SEQ ID NO: 829984 - DNA, 20 bp, mouse
ggactcctattggtggagtg

SEQ ID NO: 829985 - DNA, 20 bp, mouse
gtctcaaggggctaactatg

SEQ ID NO: 829986 - DNA, 20 bp, mouse
gcagtcttggcattgatatt

SEQ ID NO: 829987 - DNA, 20 bp, mouse
gcaaaagagcatgacttgtc

SEQ ID NO: 829988 - DNA, 20 bp, mouse
gtcgagtccgggtctcctcc

SEQ ID NO: 829989 - DNA, 20 bp, mouse
gggagacccggactcgaaac

SEQ ID NO: 829990 - DNA, 20 bp, mouse
gctaccgagtgcatgctcct

SEQ ID NO: 829991 - DNA, 20 bp, mouse
ggccaccatgggcttatatc

SEQ ID NO: 829992 - DNA, 20 bp, mouse
ggagaccactataaccatcc

SEQ ID NO: 829993 - DNA, 20 bp, mouse
gggggcccaaggacggcagt

SEQ ID NO: 829994 - DNA, 20 bp, mouse
gcaggcccactgccgtcctt

SEQ ID NO: 829995 - DNA, 20 bp, mouse
gtcctcccggatggttatag

SEQ ID NO: 829996 - DNA, 20 bp, mouse
gtgcgtgttgtctgcgtggt

SEQ ID NO: 829997 - DNA, 20 bp, mouse
gcctctgcctggagatggaa

SEQ ID NO: 829998 - DNA, 20 bp, mouse
ggctagtctcaatgggtgaa

SEQ ID NO: 829999 - DNA, 20 bp, mouse
gcctatgcaaaagctgttcg

SEQ ID NO: 830000 - DNA, 20 bp, mouse
gttcgaggtggagacagaag

SEQ ID NO: 830001 - DNA, 20 bp, mouse
ggagaaacactcccagaaag

SEQ ID NO: 830002 - DNA, 20 bp, mouse
gctccaggcagaggactcgc

SEQ ID NO: 830003 - DNA, 20 bp, mouse
gactctcgcgggaagatgta

SEQ ID NO: 830004 - DNA, 20 bp, mouse
gttaaagcgctagtctcaat

SEQ ID NO: 830005 - DNA, 20 bp, mouse
ggagacctgagaactctcgc

SEQ ID NO: 830006 - DNA, 20 bp, mouse
gggtgggcctggtctaaggt

SEQ ID NO: 830007 - DNA, 20 bp, mouse
gaacacatggcaggggcctg

SEQ ID NO: 830008 - DNA, 20 bp, mouse
gggagggtgggcctggtcta

SEQ ID NO: 830009 - DNA, 20 bp, mouse
ggcggagcctgaggctaggg

SEQ ID NO: 830010 - DNA, 20 bp, mouse
gggaaagcccacaaggctac

SEQ ID NO: 830011 - DNA, 20 bp, mouse
ggccgcgcgcggggtactgt

SEQ ID NO: 830012 - DNA, 20 bp, mouse
gtaaggtgggtgttgctgag

SEQ ID NO: 830013 - DNA, 20 bp, mouse
gccccgcccactgagcggtg

SEQ ID NO: 830014 - DNA, 20 bp, mouse
gcgtgctgttgctggaccat

SEQ ID NO: 830015 - DNA, 20 bp, mouse
ggcccaggagaacacatggc

SEQ ID NO: 830016 - DNA, 20 bp, mouse
ggccaggagaagggcgagga

SEQ ID NO: 830017 - DNA, 20 bp, mouse
gttcgcgaggagcaggaaaa

SEQ ID NO: 830018 - DNA, 20 bp, mouse
gctcggagatctccctctaa

SEQ ID NO: 830019 - DNA, 20 bp, mouse
gagctctaggaagagttgtt

SEQ ID NO: 830020 - DNA, 20 bp, mouse
gcgctccgacccaggtataa

SEQ ID NO: 830021 - DNA, 20 bp, mouse
ggggcggtgagcaaaagagg

SEQ ID NO: 830022 - DNA, 20 bp, mouse
gcggcggcagattgtggtcc

SEQ ID NO: 830023 - DNA, 20 bp, mouse
gtgcgggcggtgagcaaaag

SEQ ID NO: 830024 - DNA, 20 bp, mouse
gggggacgctcgaacaggga

SEQ ID NO: 830025 - DNA, 20 bp, mouse
gaggacccgaagacaggcga

SEQ ID NO: 830026 - DNA, 20 bp, mouse
gcgactcggtggtacaagtt

SEQ ID NO: 830027 - DNA, 20 bp, mouse
gcctgggaggatagagatcg

SEQ ID NO: 830028 - DNA, 20 bp, mouse
gaaggcgccgcgcgactcgg

SEQ ID NO: 830029 - DNA, 20 bp, mouse
ggctcgcggcagcgtccgcg

SEQ ID NO: 830030 - DNA, 20 bp, mouse
gcaggactccagtcaccgcg

SEQ ID NO: 830031 - DNA, 20 bp, mouse
gtctcggcgccttttgtgtg

SEQ ID NO: 830032 - DNA, 20 bp, mouse
gtgaaatcctaaccgatcct

SEQ ID NO: 830033 - DNA, 20 bp, mouse
gtatcctcccaggatcggtt

SEQ ID NO: 830034 - DNA, 20 bp, mouse
gcgagcgccggagccccgct

SEQ ID NO: 830035 - DNA, 20 bp, mouse
gatctctatcctcccaggat

SEQ ID NO: 830036 - DNA, 20 bp, mouse
ggggagaggagcgtcggatt

SEQ ID NO: 830037 - DNA, 20 bp, mouse
gtgcgatgggagaggagcgt

SEQ ID NO: 830038 - DNA, 20 bp, mouse
gtaaatgcacggttagtctg

SEQ ID NO: 830039 - DNA, 20 bp, mouse
gaatgtttttctgtctgctg

SEQ ID NO: 830040 - DNA, 20 bp, mouse
gaacagatataagttgcgat

SEQ ID NO: 830041 - DNA, 20 bp, mouse
gccccatttccaattataga

SEQ ID NO: 830042 - DNA, 20 bp, mouse
ggatggatcattacagacag

SEQ ID NO: 830043 - DNA, 20 bp, mouse
ggttgtctcaaacaataggc

SEQ ID NO: 830044 - DNA, 20 bp, mouse
gatctgttgtctcaaacaat

SEQ ID NO: 830045 - DNA, 20 bp, mouse
gatataagttgcgatgggag

SEQ ID NO: 830046 - DNA, 20 bp, mouse
ggggctcgcaggggcatcag

SEQ ID NO: 830047 - DNA, 20 bp, mouse
gtcgcaggggcatcagtggg

SEQ ID NO: 830048 - DNA, 20 bp, mouse
gcaacacgctaggcagggtg

SEQ ID NO: 830049 - DNA, 20 bp, mouse
gcgtcgcgaggggctcgcag

SEQ ID NO: 830050 - DNA, 20 bp, mouse
gcaggaccaggcgtcgcgag

SEQ ID NO: 830051 - DNA, 20 bp, mouse
gcctggtcctgcaacacgct

SEQ ID NO: 830052 - DNA, 20 bp, mouse
gggcggagctaggcagggac

SEQ ID NO: 830053 - DNA, 20 bp, mouse
gaagctgaggtgcccaaacg

SEQ ID NO: 830054 - DNA, 20 bp, mouse
gtgcggggcggagctaggca

SEQ ID NO: 830055 - DNA, 20 bp, mouse
gtgtcagctctgccagtcta

SEQ ID NO: 830056 - DNA, 20 bp, mouse
ggaacccccagttccttatt

SEQ ID NO: 830057 - DNA, 20 bp, mouse
gtgagaacggggaggacaat

SEQ ID NO: 830058 - DNA, 20 bp, mouse
ggatgcgtcctcacctcagt

SEQ ID NO: 830059 - DNA, 20 bp, mouse
gtcgcctaataaggaactgg

SEQ ID NO: 830060 - DNA, 20 bp, mouse
gagcatcagcagtgagaacg

SEQ ID NO: 830061 - DNA, 20 bp, mouse
gtctgtaagctgcatgtatt

SEQ ID NO: 830062 - DNA, 20 bp, mouse
gtacttgctgagaatttctt

SEQ ID NO: 830063 - DNA, 20 bp, mouse
ggatcagctttcaacatcca

SEQ ID NO: 830064 - DNA, 20 bp, mouse
ggcaatcagtcttgcccagt

SEQ ID NO: 830065 - DNA, 20 bp, mouse
gtcttcgcctaataaggaac

SEQ ID NO: 830066 - DNA, 20 bp, mouse
ggctctggtgggaaccggtg

SEQ ID NO: 830067 - DNA, 20 bp, mouse
gagaaggagctcacatcagc

SEQ ID NO: 830068 - DNA, 20 bp, mouse
gcaggggtctgtgttcgctc

SEQ ID NO: 830069 - DNA, 20 bp, mouse
gcttgcagctgcgatcaaat

SEQ ID NO: 830070 - DNA, 20 bp, mouse
gcacccgtgtgcccgatgtg

SEQ ID NO: 830071 - DNA, 20 bp, mouse
gatcaaatgggattcgaggc

SEQ ID NO: 830072 - DNA, 20 bp, mouse
gggcgcgctcgggcctctgg

SEQ ID NO: 830073 - DNA, 20 bp, mouse
gagggaggcgtggctctggt

SEQ ID NO: 830074 - DNA, 20 bp, mouse
gcccttggctgcggaaaggg

SEQ ID NO: 830075 - DNA, 20 bp, mouse
gtaactagagtgcatggagc

SEQ ID NO: 830076 - DNA, 20 bp, mouse
gactccgcggaaggaggccg

SEQ ID NO: 830077 - DNA, 20 bp, mouse
gagaagggcgcaagctcctt

SEQ ID NO: 830078 - DNA, 20 bp, mouse
gtggggggacacgatgtgaa

SEQ ID NO: 830079 - DNA, 20 bp, mouse
gctggatgctggggcgagaa

SEQ ID NO: 830080 - DNA, 20 bp, mouse
gactccccggcctccttccg

SEQ ID NO: 830081 - DNA, 20 bp, mouse
gttgggaccgactactacat

SEQ ID NO: 830082 - DNA, 20 bp, mouse
ggcatccagtcgccctgggg

SEQ ID NO: 830083 - DNA, 20 bp, mouse
gccagcatccagtcgccctg

SEQ ID NO: 830084 - DNA, 20 bp, mouse
ggggtctgcagacttaaccc

SEQ ID NO: 830085 - DNA, 20 bp, mouse
gtacacacgcccggggaggc

SEQ ID NO: 830086 - DNA, 20 bp, mouse
ggccgaaagcggtgcaggtt

SEQ ID NO: 830087 - DNA, 20 bp, mouse
gcaagcctttggaatgtcaa

SEQ ID NO: 830088 - DNA, 20 bp, mouse
gggcctgcggagcctcccag

SEQ ID NO: 830089 - DNA, 20 bp, mouse
ggtcaggccgaaagcggtgc

SEQ ID NO: 830090 - DNA, 20 bp, mouse
ggggcggaggctaggaggcg

SEQ ID NO: 830091 - DNA, 20 bp, mouse
gcggaaatgacgaaactgac

SEQ ID NO: 830092 - DNA, 20 bp, mouse
gtagcaggaaagatggtgat

SEQ ID NO: 830093 - DNA, 20 bp, mouse
gtgggagctcaggacgcgtc

SEQ ID NO: 830094 - DNA, 20 bp, mouse
gcaggcctttgacattccaa

SEQ ID NO: 830095 - DNA, 20 bp, mouse
gacaggaagtctgtatgtac

SEQ ID NO: 830096 - DNA, 20 bp, mouse
gtccctctgcgcaaccctcc

SEQ ID NO: 830097 - DNA, 20 bp, mouse
ggctagagaggaagtgcgga

SEQ ID NO: 830098 - DNA, 20 bp, mouse
gcgcggctagagaggaagtg

SEQ ID NO: 830099 - DNA, 20 bp, mouse
gagccgggagggttgcgcag

SEQ ID NO: 830100 - DNA, 20 bp, mouse
gcgccggctcgggtctcccg

SEQ ID NO: 830101 - DNA, 20 bp, mouse
ggggtctcccgcggcactgg

SEQ ID NO: 830102 - DNA, 20 bp, mouse
gtgccgcgggagacccgagc

SEQ ID NO: 830103 - DNA, 20 bp, mouse
gtgcgagaccgcggctagag

SEQ ID NO: 830104 - DNA, 20 bp, mouse
ggggacccgctgcaactccg

SEQ ID NO: 830105 - DNA, 20 bp, mouse
gagagaggaagtgcggaggg

SEQ ID NO: 830106 - DNA, 20 bp, mouse
gagcccgcccactactccgg

SEQ ID NO: 830107 - DNA, 20 bp, mouse
gcggtcgtggtggctaagga

SEQ ID NO: 830108 - DNA, 20 bp, mouse
gcttccgcccccggagtagt

SEQ ID NO: 830109 - DNA, 20 bp, mouse
gcgcccccggagtagtgggc

SEQ ID NO: 830110 - DNA, 20 bp, mouse
gaacccgggtcgcaggctct

SEQ ID NO: 830111 - DNA, 20 bp, mouse
gtgataggctatcgacgcga

SEQ ID NO: 830112 - DNA, 20 bp, mouse
gacgcgaaggcttccgcccc

SEQ ID NO: 830113 - DNA, 20 bp, mouse
gtgctgagagcggagtgggg

SEQ ID NO: 830114 - DNA, 20 bp, mouse
gaggcgtgaacccgggtcgc

SEQ ID NO: 830115 - DNA, 20 bp, mouse
ggacggctcggaggaaccct

SEQ ID NO: 830116 - DNA, 20 bp, mouse
ggacacagccactctcgctg

SEQ ID NO: 830117 - DNA, 20 bp, mouse
gtaggggcgtggttattgca

SEQ ID NO: 830118 - DNA, 20 bp, mouse
gcagtaggccacagcgagag

SEQ ID NO: 830119 - DNA, 20 bp, mouse
gcacccactcgaacctgagt

SEQ ID NO: 830120 - DNA, 20 bp, mouse
gtcgccctgagcaactgcct

SEQ ID NO: 830121 - DNA, 20 bp, mouse
gccacctgacggcctataaa

SEQ ID NO: 830122 - DNA, 20 bp, mouse
gcaggtgggcgtggcattag

SEQ ID NO: 830123 - DNA, 20 bp, mouse
gtaaaggtggacggcggcca

SEQ ID NO: 830124 - DNA, 20 bp, mouse
gtattgcagggccgtcccta

SEQ ID NO: 830125 - DNA, 20 bp, mouse
gagcccaaggcagttgctca

SEQ ID NO: 830126 - DNA, 20 bp, mouse
gaggcgcgggagatgagcgg

SEQ ID NO: 830127 - DNA, 20 bp, mouse
gcatctcccgcgcctctcgc

SEQ ID NO: 830128 - DNA, 20 bp, mouse
ggcgcagcgctgttcggcgt

SEQ ID NO: 830129 - DNA, 20 bp, mouse
gtagcaccggcgagaggcgc

SEQ ID NO: 830130 - DNA, 20 bp, mouse
gcagcgctgttcggcgtcgg

SEQ ID NO: 830131 - DNA, 20 bp, mouse
ggtgctacccgccctgggag

SEQ ID NO: 830132 - DNA, 20 bp, mouse
gtcgccggtgctacccgccc

SEQ ID NO: 830133 - DNA, 20 bp, mouse
gaggaggaggagggcgccga

SEQ ID NO: 830134 - DNA, 20 bp, mouse
gtccatgtgcgctcggagag

SEQ ID NO: 830135 - DNA, 20 bp, mouse
ggcgcgcggcgcggtgacgt

SEQ ID NO: 830136 - DNA, 20 bp, mouse
gccgggccgcagtgcgtgta

SEQ ID NO: 830137 - DNA, 20 bp, mouse
gtccgctaggggccgccctg

SEQ ID NO: 830138 - DNA, 20 bp, mouse
gcgcgcgccgacgctctcca

SEQ ID NO: 830139 - DNA, 20 bp, mouse
ggcccccaggctcgccccca

SEQ ID NO: 830140 - DNA, 20 bp, mouse
gctgcggcccggccaatccg

SEQ ID NO: 830141 - DNA, 20 bp, mouse
ggaggtcaaaagaccagggc

SEQ ID NO: 830142 - DNA, 20 bp, mouse
ggccgacgctctccacggat

SEQ ID NO: 830143 - DNA, 20 bp, mouse
gcgcgcgtcatgccagccga

SEQ ID NO: 830144 - DNA, 20 bp, mouse
gtggctgccctctaggtggc

SEQ ID NO: 830145 - DNA, 20 bp, mouse
ggccgcggccgtgtcgctga

SEQ ID NO: 830146 - DNA, 20 bp, mouse
ggaaactgcccagcccttgt

SEQ ID NO: 830147 - DNA, 20 bp, mouse
gttgaagcatggcctatctc

SEQ ID NO: 830148 - DNA, 20 bp, mouse
gtcactttggcgttgaagca

SEQ ID NO: 830149 - DNA, 20 bp, mouse
gaagcatggcctatctcagg

SEQ ID NO: 830150 - DNA, 20 bp, mouse
gaccagcctgtcattcactt

SEQ ID NO: 830151 - DNA, 20 bp, mouse
ggccaaagtgaatgacaggc

SEQ ID NO: 830152 - DNA, 20 bp, mouse
gggttagtcttttacatcca

SEQ ID NO: 830153 - DNA, 20 bp, mouse
gagttagtcttaaacgtttt

SEQ ID NO: 830154 - DNA, 20 bp, mouse
ggagctctgagcagtttttc

SEQ ID NO: 830155 - DNA, 20 bp, mouse
gaacgtttaagactaactgt

SEQ ID NO: 830156 - DNA, 20 bp, mouse
gtgggctggggaaactccac

SEQ ID NO: 830157 - DNA, 20 bp, mouse
gttccccagcccaaggagga

SEQ ID NO: 830158 - DNA, 20 bp, mouse
gtgcgggctgggaagatcca

SEQ ID NO: 830159 - DNA, 20 bp, mouse
ggcaactggctgccttgctc

SEQ ID NO: 830160 - DNA, 20 bp, mouse
gccgggaggcggaagcaaat

SEQ ID NO: 830161 - DNA, 20 bp, mouse
gcgaagtcgtggcttagggc

SEQ ID NO: 830162 - DNA, 20 bp, mouse
gcctaagccacgacttcgag

SEQ ID NO: 830163 - DNA, 20 bp, mouse
gggaggcgagcggtcgttcg

SEQ ID NO: 830164 - DNA, 20 bp, mouse
gttcgagcggtagggaacac

SEQ ID NO: 830165 - DNA, 20 bp, mouse
gtcggcccgcccttcggaaa

SEQ ID NO: 830166 - DNA, 20 bp, mouse
gaatcccggcgagcccttcg

SEQ ID NO: 830167 - DNA, 20 bp, mouse
ggggacgcagagaacggaga

SEQ ID NO: 830168 - DNA, 20 bp, mouse
gtcccagcgggcacagcggt

SEQ ID NO: 830169 - DNA, 20 bp, mouse
gggaacagcggccagtagaa

SEQ ID NO: 830170 - DNA, 20 bp, mouse
gtccccgtcgcagccgcgaa

SEQ ID NO: 830171 - DNA, 20 bp, mouse
ggggcggtccgcaggagggg

SEQ ID NO: 830172 - DNA, 20 bp, mouse
ggggcacagcggtaggccta

SEQ ID NO: 830173 - DNA, 20 bp, mouse
gctactggccgctgttccct

SEQ ID NO: 830174 - DNA, 20 bp, mouse
gcacagcggtaggcctatgg

SEQ ID NO: 830175 - DNA, 20 bp, mouse
ggcgcccggcgcttgggctc

SEQ ID NO: 830176 - DNA, 20 bp, mouse
gactgccattgtaaattctg

SEQ ID NO: 830177 - DNA, 20 bp, mouse
gagtccaggaaatgccctaa

SEQ ID NO: 830178 - DNA, 20 bp, mouse
gacacagcagttttaagtta

SEQ ID NO: 830179 - DNA, 20 bp, mouse
gtccagaaaaactactccag

SEQ ID NO: 830180 - DNA, 20 bp, mouse
gaccactggagtagtttttc

SEQ ID NO: 830181 - DNA, 20 bp, mouse
gtttactgtagtcacaccac

SEQ ID NO: 830182 - DNA, 20 bp, mouse
gtatgtggttattagctcag

SEQ ID NO: 830183 - DNA, 20 bp, mouse
gaaaagagaagtcacccatt

SEQ ID NO: 830184 - DNA, 20 bp, mouse
gttctccttcctcaactaag

SEQ ID NO: 830185 - DNA, 20 bp, mouse
gaatgtgttgcaataactgt

SEQ ID NO: 830186 - DNA, 20 bp, mouse
gggctgagagtgcactgata

SEQ ID NO: 830187 - DNA, 20 bp, mouse
gtggatgaaggtcatgtcaa

SEQ ID NO: 830188 - DNA, 20 bp, mouse
gcatgtcaagggaggtactc

SEQ ID NO: 830189 - DNA, 20 bp, mouse
gccctctcgtaagatacact

SEQ ID NO: 830190 - DNA, 20 bp, mouse
ggagagtgcactgataggga

SEQ ID NO: 830191 - DNA, 20 bp, mouse
ggtttctgagatgcagtcac

SEQ ID NO: 830192 - DNA, 20 bp, mouse
gaccactcgggactggatga

SEQ ID NO: 830193 - DNA, 20 bp, mouse
gccaaaggagggtccatgct

SEQ ID NO: 830194 - DNA, 20 bp, mouse
gggtttttctaataccactc

SEQ ID NO: 830195 - DNA, 20 bp, mouse
gtagcgagagaccacagaca

SEQ ID NO: 830196 - DNA, 20 bp, mouse
gtgacccagcccatgtccgg

SEQ ID NO: 830197 - DNA, 20 bp, mouse
gcacgtatgcaactggaata

SEQ ID NO: 830198 - DNA, 20 bp, mouse
gctgacatggctccaagtgg

SEQ ID NO: 830199 - DNA, 20 bp, mouse
gaggcttggggccacgagta

SEQ ID NO: 830200 - DNA, 20 bp, mouse
gcgtgccaggttactgaaag

SEQ ID NO: 830201 - DNA, 20 bp, mouse
gcacgaggctaatcccttcc

SEQ ID NO: 830202 - DNA, 20 bp, mouse
gtctgcacaaagaacctagg

SEQ ID NO: 830203 - DNA, 20 bp, mouse
ggaaaaacccctccggacat

SEQ ID NO: 830204 - DNA, 20 bp, mouse
ggaggtgggaaaaacccctc

SEQ ID NO: 830205 - DNA, 20 bp, mouse
ggggagggggagcatctcca

SEQ ID NO: 830206 - DNA, 20 bp, mouse
gtgtccccaacttaggactg

SEQ ID NO: 830207 - DNA, 20 bp, mouse
gcctccccagtcctaagttg

SEQ ID NO: 830208 - DNA, 20 bp, mouse
ggggtcttcttcattgttct

SEQ ID NO: 830209 - DNA, 20 bp, mouse
gcacaagtgacagacgagat

SEQ ID NO: 830210 - DNA, 20 bp, mouse
ggatgtggacaaagtaaccc

SEQ ID NO: 830211 - DNA, 20 bp, mouse
gtctgtgatgctgtaaggca

SEQ ID NO: 830212 - DNA, 20 bp, mouse
gttgattgacagatctgcca

SEQ ID NO: 830213 - DNA, 20 bp, mouse
gaagtgacagacgagattgg

SEQ ID NO: 830214 - DNA, 20 bp, mouse
ggacgagattggtggtgatg

SEQ ID NO: 830215 - DNA, 20 bp, mouse
gttcattgttctcggtgagg

SEQ ID NO: 830216 - DNA, 20 bp, mouse
gcgcatgcgcagtgggtgag

SEQ ID NO: 830217 - DNA, 20 bp, mouse
gggcgaagaccccgctgcgt

SEQ ID NO: 830218 - DNA, 20 bp, mouse
gactgcgcatgcgtcctgac

SEQ ID NO: 830219 - DNA, 20 bp, mouse
ggggcggggcgtagtctgca

SEQ ID NO: 830220 - DNA, 20 bp, mouse
gtacactcggtcatccagtg

SEQ ID NO: 830221 - DNA, 20 bp, mouse
gcgcaggggcgggagcgaag

SEQ ID NO: 830222 - DNA, 20 bp, mouse
gacagccacggtcccgtacg

SEQ ID NO: 830223 - DNA, 20 bp, mouse
gccccgctgcgtcgggtgag

SEQ ID NO: 830224 - DNA, 20 bp, mouse
gtggctgtcgctaggctcgt

SEQ ID NO: 830225 - DNA, 20 bp, mouse
gccaggcgcacaagccagtc

SEQ ID NO: 830226 - DNA, 20 bp, mouse
gggcgtgtctgcaacccgga

SEQ ID NO: 830227 - DNA, 20 bp, mouse
gcagcgcgaggcgggatcac

SEQ ID NO: 830228 - DNA, 20 bp, mouse
gggctcgccctggaacgaga

SEQ ID NO: 830229 - DNA, 20 bp, mouse
gactcagcctcagttccgat

SEQ ID NO: 830230 - DNA, 20 bp, mouse
ggcctggcgacggctcgccc

SEQ ID NO: 830231 - DNA, 20 bp, mouse
gctggttcccatcggaactg

SEQ ID NO: 830232 - DNA, 20 bp, mouse
gaagtggcgcgctgttgccc

SEQ ID NO: 830233 - DNA, 20 bp, mouse
gggtcccgccagcccaaacc

SEQ ID NO: 830234 - DNA, 20 bp, mouse
gcatcgctcagaggcggaag

SEQ ID NO: 830235 - DNA, 20 bp, mouse
ggggaaccagaagcagcgcg

SEQ ID NO: 830236 - DNA, 20 bp, mouse
gtgaagagggactgcctctc

SEQ ID NO: 830237 - DNA, 20 bp, mouse
gaggatgaggccccttatag

SEQ ID NO: 830238 - DNA, 20 bp, mouse
gggtataaaaaatgcagggc

SEQ ID NO: 830239 - DNA, 20 bp, mouse
gcaaaatgagctgtccaaag

SEQ ID NO: 830240 - DNA, 20 bp, mouse
gttaacttgatcagccgcaa

SEQ ID NO: 830241 - DNA, 20 bp, mouse
gatgaggccccttatagggg

SEQ ID NO: 830242 - DNA, 20 bp, mouse
gcagcttcccttgtggacaa

SEQ ID NO: 830243 - DNA, 20 bp, mouse
gctctgcttcgtgaccagag

SEQ ID NO: 830244 - DNA, 20 bp, mouse
gaaaacaacagacgaatgta

SEQ ID NO: 830245 - DNA, 20 bp, mouse
gccctcctgaatgcactcta

SEQ ID NO: 830246 - DNA, 20 bp, mouse
gtggctgcaagcaaaacgtt

SEQ ID NO: 830247 - DNA, 20 bp, mouse
gagccagagggaaattacgg

SEQ ID NO: 830248 - DNA, 20 bp, mouse
gcggggcggagcgcataacg

SEQ ID NO: 830249 - DNA, 20 bp, mouse
ggggtccaggggtggcttaa

SEQ ID NO: 830250 - DNA, 20 bp, mouse
gcagagggaaattacggtgg

SEQ ID NO: 830251 - DNA, 20 bp, mouse
gtggaacacactgaacgcgg

SEQ ID NO: 830252 - DNA, 20 bp, mouse
gccgccccgtcgggggtcca

SEQ ID NO: 830253 - DNA, 20 bp, mouse
gtgggattcaggtttctttt

SEQ ID NO: 830254 - DNA, 20 bp, mouse
gtatgcgctccgccccgtcg

SEQ ID NO: 830255 - DNA, 20 bp, mouse
gctactgagcggaatccgtt

SEQ ID NO: 830256 - DNA, 20 bp, mouse
gaggtgacaacgtggacgat

SEQ ID NO: 830257 - DNA, 20 bp, mouse
gtggagtcgggtgcaaacga

SEQ ID NO: 830258 - DNA, 20 bp, mouse
gagtaaagaaggtgacaacg

SEQ ID NO: 830259 - DNA, 20 bp, mouse
ggcgctagaggataaaccga

SEQ ID NO: 830260 - DNA, 20 bp, mouse
ggcctcgcgggacggcgacc

SEQ ID NO: 830261 - DNA, 20 bp, mouse
gtgcacccgactccaaattg

SEQ ID NO: 830262 - DNA, 20 bp, mouse
gctgccggaaatgtcgtaaa

SEQ ID NO: 830263 - DNA, 20 bp, mouse
gggacggcgaccgggagtgc

SEQ ID NO: 830264 - DNA, 20 bp, mouse
gtggccggaagccaagctac

SEQ ID NO: 830265 - DNA, 20 bp, mouse
gaggtcaggtggtacctgga

SEQ ID NO: 830266 - DNA, 20 bp, mouse
gctacattcgtgctactctg

SEQ ID NO: 830267 - DNA, 20 bp, mouse
gtctggggcacgaatttctt

SEQ ID NO: 830268 - DNA, 20 bp, mouse
gtccagaaaaggacgtgcgg

SEQ ID NO: 830269 - DNA, 20 bp, mouse
gggcggagtcctctggggcg

SEQ ID NO: 830270 - DNA, 20 bp, mouse
gtctgtactgagctggttgt

SEQ ID NO: 830271 - DNA, 20 bp, mouse
gaagtgtttgacttctttgg

SEQ ID NO: 830272 - DNA, 20 bp, mouse
gaatttcttaggttttagtg

SEQ ID NO: 830273 - DNA, 20 bp, mouse
ggggcgtgctctagtgggtg

SEQ ID NO: 830274 - DNA, 20 bp, mouse
gggggaggggggcaacttca

SEQ ID NO: 830275 - DNA, 20 bp, mouse
gcctgggggcgtgctctagt

SEQ ID NO: 830276 - DNA, 20 bp, mouse
ggctcccccaagaccgctgg

SEQ ID NO: 830277 - DNA, 20 bp, mouse
gggtgctcccccaagaccgc

SEQ ID NO: 830278 - DNA, 20 bp, mouse
ggcgccaaggcggcaggtgt

SEQ ID NO: 830279 - DNA, 20 bp, mouse
gccgccttggcgccttttct

SEQ ID NO: 830280 - DNA, 20 bp, mouse
ggagcgcgtgcgattggctg

SEQ ID NO: 830281 - DNA, 20 bp, mouse
gaactccaaagacacggcgg

SEQ ID NO: 830282 - DNA, 20 bp, mouse
ggcgcggagtagcctagaaa

SEQ ID NO: 830283 - DNA, 20 bp, mouse
gtcgcctccagcggtcttgg

SEQ ID NO: 830284 - DNA, 20 bp, mouse
ggcaccgcagggttgggtgt

SEQ ID NO: 830285 - DNA, 20 bp, mouse
gtccaaagacacggcggggg

SEQ ID NO: 830286 - DNA, 20 bp, mouse
gaatactcaagtggtcagta

SEQ ID NO: 830287 - DNA, 20 bp, mouse
ggggacaagaaatgtgaggt

SEQ ID NO: 830288 - DNA, 20 bp, mouse
ggtgaccactccagtctatg

SEQ ID NO: 830289 - DNA, 20 bp, mouse
gtatggggacaagaaatgtg

SEQ ID NO: 830290 - DNA, 20 bp, mouse
gcccactaagaatactcaag

SEQ ID NO: 830291 - DNA, 20 bp, mouse
ggaacttctgtcactcctaa

SEQ ID NO: 830292 - DNA, 20 bp, mouse
gaagttcgatcataaaactg

SEQ ID NO: 830293 - DNA, 20 bp, mouse
gtgttcaaggacacttgaca

SEQ ID NO: 830294 - DNA, 20 bp, mouse
ggcttgccactgtgctataa

SEQ ID NO: 830295 - DNA, 20 bp, mouse
ggaattcagaatcgtactga

SEQ ID NO: 830296 - DNA, 20 bp, mouse
gtctcctagctggtgactat

SEQ ID NO: 830297 - DNA, 20 bp, mouse
gtcaccagctaggagaaatt

SEQ ID NO: 830298 - DNA, 20 bp, mouse
gccggctccgcccctctttt

SEQ ID NO: 830299 - DNA, 20 bp, mouse
gttctcccagaccccaaaag

SEQ ID NO: 830300 - DNA, 20 bp, mouse
gccgcccccgacacgttcaa

SEQ ID NO: 830301 - DNA, 20 bp, mouse
ggcggcgtctgaagaaccga

SEQ ID NO: 830302 - DNA, 20 bp, mouse
ggaccctaatttctcctagc

SEQ ID NO: 830303 - DNA, 20 bp, mouse
gtaggagaaattagggtcat

SEQ ID NO: 830304 - DNA, 20 bp, mouse
gcgttcaaaggaagtcgcag

SEQ ID NO: 830305 - DNA, 20 bp, mouse
ggcctgcgcagtgccactgc

SEQ ID NO: 830306 - DNA, 20 bp, mouse
gactacgcaggggactcggg

SEQ ID NO: 830307 - DNA, 20 bp, mouse
gagggtggtccgcctctccc

SEQ ID NO: 830308 - DNA, 20 bp, mouse
ggcctctccccggtcgccta

SEQ ID NO: 830309 - DNA, 20 bp, mouse
gggggcgccccatcgcggga

SEQ ID NO: 830310 - DNA, 20 bp, mouse
gttcgggggcgccccatcgc

SEQ ID NO: 830311 - DNA, 20 bp, mouse
gggtggggactggaagccgg

SEQ ID NO: 830312 - DNA, 20 bp, mouse
ggctactacgcaggggactc

SEQ ID NO: 830313 - DNA, 20 bp, mouse
ggcgtccaggctgtaggcgg

SEQ ID NO: 830314 - DNA, 20 bp, mouse
gcccacccctgcgccttcgg

SEQ ID NO: 830315 - DNA, 20 bp, mouse
gggacgaccgcgcctcccgg

SEQ ID NO: 830316 - DNA, 20 bp, mouse
gcggcctcgccccacctcca

SEQ ID NO: 830317 - DNA, 20 bp, mouse
gccctccccgcagggctgaa

SEQ ID NO: 830318 - DNA, 20 bp, mouse
ggggctgaagggacccccct

SEQ ID NO: 830319 - DNA, 20 bp, mouse
ggggtcccttcagccctgcg

SEQ ID NO: 830320 - DNA, 20 bp, mouse
gcgtgggcgggctccaaggg

SEQ ID NO: 830321 - DNA, 20 bp, mouse
ggggcgctttggttggtcac

SEQ ID NO: 830322 - DNA, 20 bp, mouse
gtagcgtgggcgggctccaa

SEQ ID NO: 830323 - DNA, 20 bp, mouse
gttagaagtggggacctagg

SEQ ID NO: 830324 - DNA, 20 bp, mouse
gggcggagcactactaaagc

SEQ ID NO: 830325 - DNA, 20 bp, mouse
ggggtgctgcctcctggcgg

SEQ ID NO: 830326 - DNA, 20 bp, mouse
ggggacccgctgggatacag

SEQ ID NO: 830327 - DNA, 20 bp, mouse
gacccgctgggatacagtgg

SEQ ID NO: 830328 - DNA, 20 bp, mouse
gtatggaagccgggacccgc

SEQ ID NO: 830329 - DNA, 20 bp, mouse
gacgtcagggagttagaagc

SEQ ID NO: 830330 - DNA, 20 bp, mouse
gcgctgggatacagtggggg

SEQ ID NO: 830331 - DNA, 20 bp, mouse
gctgccgctgaggcaaaggc

SEQ ID NO: 830332 - DNA, 20 bp, mouse
ggggtcccggcttccataca

SEQ ID NO: 830333 - DNA, 20 bp, mouse
gcccacccaatccagctttg

SEQ ID NO: 830334 - DNA, 20 bp, mouse
gaccccagcctttgcctcag

SEQ ID NO: 830335 - DNA, 20 bp, mouse
gcctccgcccccaccggaca

SEQ ID NO: 830336 - DNA, 20 bp, mouse
gagctctggaccattggagg

SEQ ID NO: 830337 - DNA, 20 bp, mouse
gggggacggccagtaaggga

SEQ ID NO: 830338 - DNA, 20 bp, mouse
gtacacgcctgtacatgcat

SEQ ID NO: 830339 - DNA, 20 bp, mouse
gaggcagatgcgccccggag

SEQ ID NO: 830340 - DNA, 20 bp, mouse
gcctctgtggatctccgggg

SEQ ID NO: 830341 - DNA, 20 bp, mouse
gggcacgcactcaacacagg

SEQ ID NO: 830342 - DNA, 20 bp, mouse
gcatctgcggagagaaggat

SEQ ID NO: 830343 - DNA, 20 bp, mouse
gttactaagaccacgagctc

SEQ ID NO: 830344 - DNA, 20 bp, mouse
gcggcctctgtggatctccg

SEQ ID NO: 830345 - DNA, 20 bp, mouse
gaaagggggacggccagtaa

SEQ ID NO: 830346 - DNA, 20 bp, mouse
gcggggaaggcgagagagtg

SEQ ID NO: 830347 - DNA, 20 bp, mouse
gccccaggccgatacgtcat

SEQ ID NO: 830348 - DNA, 20 bp, mouse
ggacgtatcggcctggggtg

SEQ ID NO: 830349 - DNA, 20 bp, mouse
gcaggccgatacgtcatggg

SEQ ID NO: 830350 - DNA, 20 bp, mouse
gcctccctcccatgacgtat

SEQ ID NO: 830351 - DNA, 20 bp, mouse
gaagaagagggccgagtgta

SEQ ID NO: 830352 - DNA, 20 bp, mouse
gtgtgtccccggtctgtccg

SEQ ID NO: 830353 - DNA, 20 bp, mouse
ggagagaggcttgtgtgcgc

SEQ ID NO: 830354 - DNA, 20 bp, mouse
gcgagccgggttccaccctg

SEQ ID NO: 830355 - DNA, 20 bp, mouse
gggaatgactccaagaggag

SEQ ID NO: 830356 - DNA, 20 bp, mouse
gtgagctgggcggtgcagga

SEQ ID NO: 830357 - DNA, 20 bp, mouse
gcgggtgcttagtagtggcg

SEQ ID NO: 830358 - DNA, 20 bp, mouse
gactttgtgcgaagtgggag

SEQ ID NO: 830359 - DNA, 20 bp, mouse
ggggcgcgggtgcttagtag

SEQ ID NO: 830360 - DNA, 20 bp, mouse
gctgctagagagctatcttc

SEQ ID NO: 830361 - DNA, 20 bp, mouse
gctgtccgtgcctaagtgtg

SEQ ID NO: 830362 - DNA, 20 bp, mouse
gtgctgactccctcacactt

SEQ ID NO: 830363 - DNA, 20 bp, mouse
ggcacaaagtgcgggtccaa

SEQ ID NO: 830364 - DNA, 20 bp, mouse
gcccacttcgcacaaagtgc

SEQ ID NO: 830365 - DNA, 20 bp, mouse
gtagctctctagcagactgc

SEQ ID NO: 830366 - DNA, 20 bp, mouse
gcagaggcccagcagtgcgg

SEQ ID NO: 830367 - DNA, 20 bp, mouse
gtaaaggcgcccagcggtga

SEQ ID NO: 830368 - DNA, 20 bp, mouse
gtctcggctaggtcccgcta

SEQ ID NO: 830369 - DNA, 20 bp, mouse
gccgcccgcgagcgccctag

SEQ ID NO: 830370 - DNA, 20 bp, mouse
ggtcccgctagggcgctcgc

SEQ ID NO: 830371 - DNA, 20 bp, mouse
ggaaacccacggccgctcat

SEQ ID NO: 830372 - DNA, 20 bp, mouse
gagtgcgggggcgtggttag

SEQ ID NO: 830373 - DNA, 20 bp, mouse
gtggtagcccagggccccgc

SEQ ID NO: 830374 - DNA, 20 bp, mouse
gcccgctgtggctggagtaa

SEQ ID NO: 830375 - DNA, 20 bp, mouse
gtagccgagagccccgcccg

SEQ ID NO: 830376 - DNA, 20 bp, mouse
gccggagctggaaggctctc

SEQ ID NO: 830377 - DNA, 20 bp, mouse
ggggcaggacctctcgccgc

SEQ ID NO: 830378 - DNA, 20 bp, mouse
gcgcgcgcggggggtgtcgt

SEQ ID NO: 830379 - DNA, 20 bp, mouse
ggagctggaaggctctccgg

SEQ ID NO: 830380 - DNA, 20 bp, mouse
gtcctcgccaacagctgggc

SEQ ID NO: 830381 - DNA, 20 bp, mouse
gcgggcgccgagagggaaac

SEQ ID NO: 830382 - DNA, 20 bp, mouse
ggtaatgcctagaaggtgtg

SEQ ID NO: 830383 - DNA, 20 bp, mouse
gcccagacttggcggggtgg

SEQ ID NO: 830384 - DNA, 20 bp, mouse
gggcggggtgggggttgcgt

SEQ ID NO: 830385 - DNA, 20 bp, mouse
gtgcgtgggagcgctgggag

SEQ ID NO: 830386 - DNA, 20 bp, mouse
gtctgcccgaagggaagcac

SEQ ID NO: 830387 - DNA, 20 bp, mouse
gggggggttcggcccgagat

SEQ ID NO: 830388 - DNA, 20 bp, mouse
gaggctggagcaagctctct

SEQ ID NO: 830389 - DNA, 20 bp, mouse
gcgtgtgcgcggccgagtta

SEQ ID NO: 830390 - DNA, 20 bp, mouse
gtggagctgtaaggatagaa

SEQ ID NO: 830391 - DNA, 20 bp, mouse
gccccggcctggaagaagtg

SEQ ID NO: 830392 - DNA, 20 bp, mouse
gaggaggaggagtttctagg

SEQ ID NO: 830393 - DNA, 20 bp, mouse
gccagccttctctgcccgaa

SEQ ID NO: 830394 - DNA, 20 bp, mouse
ggatgacagctgggcatccc

SEQ ID NO: 830395 - DNA, 20 bp, mouse
ggcttcccttcgggcagaga

SEQ ID NO: 830396 - DNA, 20 bp, mouse
ggctccgcgtcagggcccgg

SEQ ID NO: 830397 - DNA, 20 bp, mouse
gggaccgcagccctcgggag

SEQ ID NO: 830398 - DNA, 20 bp, mouse
gggagacgctcccctcccga

SEQ ID NO: 830399 - DNA, 20 bp, mouse
ggtagccaacatggagtgga

SEQ ID NO: 830400 - DNA, 20 bp, mouse
ggaccgggaccgcagccctc

SEQ ID NO: 830401 - DNA, 20 bp, mouse
gcgacccccgggccctgacg

SEQ ID NO: 830402 - DNA, 20 bp, mouse
gctgacgcggagcctcccag

SEQ ID NO: 830403 - DNA, 20 bp, mouse
gggcccgggggtcgggaagg

SEQ ID NO: 830404 - DNA, 20 bp, mouse
gttcgcgcttcccaggcggg

SEQ ID NO: 830405 - DNA, 20 bp, mouse
ggcgctggcgagtgcgcagg

SEQ ID NO: 830406 - DNA, 20 bp, mouse
gccgccagcgcgtagaggga

SEQ ID NO: 830407 - DNA, 20 bp, mouse
gggttccgccagcgcgtaga

SEQ ID NO: 830408 - DNA, 20 bp, mouse
gctggcggaacccagaagca

SEQ ID NO: 830409 - DNA, 20 bp, mouse
gcacccgtccctctacgcgc

SEQ ID NO: 830410 - DNA, 20 bp, mouse
ggtagagggacgggtgatct

SEQ ID NO: 830411 - DNA, 20 bp, mouse
ggcccccaggcccagggttg

SEQ ID NO: 830412 - DNA, 20 bp, mouse
ggatctcggcccccaggccc

SEQ ID NO: 830413 - DNA, 20 bp, mouse
gcttccagctccacaaccct

SEQ ID NO: 830414 - DNA, 20 bp, mouse
ggcttctgattcaaggggtg

SEQ ID NO: 830415 - DNA, 20 bp, mouse
gcccaaaagagaaaccagtg

SEQ ID NO: 830416 - DNA, 20 bp, mouse
gccacgactggaacactcga

SEQ ID NO: 830417 - DNA, 20 bp, mouse
gtcgagggacctcccagtca

SEQ ID NO: 830418 - DNA, 20 bp, mouse
ggccaactccagtccacgac

SEQ ID NO: 830419 - DNA, 20 bp, mouse
gtaactttggagtccctgac

SEQ ID NO: 830420 - DNA, 20 bp, mouse
ggagtgttccagtcgtggac

SEQ ID NO: 830421 - DNA, 20 bp, mouse
ggccctagggcgatatgtgt

SEQ ID NO: 830422 - DNA, 20 bp, mouse
gtttggagtccctgactggg

SEQ ID NO: 830423 - DNA, 20 bp, mouse
ggcggtcctaaattcatcgt

SEQ ID NO: 830424 - DNA, 20 bp, mouse
gcaaactcgaggaagctccc

SEQ ID NO: 830425 - DNA, 20 bp, mouse
gcgcttggagaagcgggcgg

SEQ ID NO: 830426 - DNA, 20 bp, mouse
gagggtgcggcaggcgggat

SEQ ID NO: 830427 - DNA, 20 bp, mouse
gcagctacgcccaccctcgg

SEQ ID NO: 830428 - DNA, 20 bp, mouse
gcgggcccgcccccgagggt

SEQ ID NO: 830429 - DNA, 20 bp, mouse
gggcggggctccgacggaga

SEQ ID NO: 830430 - DNA, 20 bp, mouse
gtgggcggggcgaagccccc

SEQ ID NO: 830431 - DNA, 20 bp, mouse
ggggcgggcccgcagagcca

SEQ ID NO: 830432 - DNA, 20 bp, mouse
ggggcggagcggtgggacca

SEQ ID NO: 830433 - DNA, 20 bp, mouse
gtctgcgggcccgcccccga

SEQ ID NO: 830434 - DNA, 20 bp, mouse
gcccgcccacgcgtcggagg

SEQ ID NO: 830435 - DNA, 20 bp, mouse
ggctcccggagtcagctcca

SEQ ID NO: 830436 - DNA, 20 bp, mouse
ggggttcacattgtggtcag

SEQ ID NO: 830437 - DNA, 20 bp, mouse
gataccatgggttcacattg

SEQ ID NO: 830438 - DNA, 20 bp, mouse
gtgaaaaaaggttgcttagt

SEQ ID NO: 830439 - DNA, 20 bp, mouse
ggtaaaggcatttgtttcca

SEQ ID NO: 830440 - DNA, 20 bp, mouse
gaaagaaagatattgaaaaa

SEQ ID NO: 830441 - DNA, 20 bp, mouse
gtgtagagccaaaacgtgta

SEQ ID NO: 830442 - DNA, 20 bp, mouse
gtgtgtgtgtgggaaggaca

SEQ ID NO: 830443 - DNA, 20 bp, mouse
gcgtgtagggatgtgtgtgt

SEQ ID NO: 830444 - DNA, 20 bp, mouse
ggggggggggggagaataag

SEQ ID NO: 830445 - DNA, 20 bp, mouse
gaaatactaagtacatatat

SEQ ID NO: 830446 - DNA, 20 bp, mouse
gataccacgggttcatattg

SEQ ID NO: 830447 - DNA, 20 bp, mouse
gcacgggggggggggataag

SEQ ID NO: 830448 - DNA, 20 bp, mouse
gtgaaaaaatgttgcttagt

SEQ ID NO: 830449 - DNA, 20 bp, mouse
ggtaaaggcatttgtttcca

SEQ ID NO: 830450 - DNA, 20 bp, mouse
gaatgttgcttagtgggtaa

SEQ ID NO: 830451 - DNA, 20 bp, mouse
ggtacaagtgcacataccac

SEQ ID NO: 830452 - DNA, 20 bp, mouse
gtaaccacaatatgaacccg

SEQ ID NO: 830453 - DNA, 20 bp, mouse
gtgtagagccaaaacgtgta

SEQ ID NO: 830454 - DNA, 20 bp, mouse
gtgtgtgtgtgggaaggaca

SEQ ID NO: 830455 - DNA, 20 bp, mouse
gcgtgtagggatgtgtgtgt

SEQ ID NO: 830456 - DNA, 20 bp, mouse
gcgggtaagcagtttatgag

SEQ ID NO: 830457 - DNA, 20 bp, mouse
gcacgcgagtggaaggtgta

SEQ ID NO: 830458 - DNA, 20 bp, mouse
gcgagtggaaggtgtagggc

SEQ ID NO: 830459 - DNA, 20 bp, mouse
gaggaactgaggtcatgcta

SEQ ID NO: 830460 - DNA, 20 bp, mouse
gtgggggctgtcctctggta

SEQ ID NO: 830461 - DNA, 20 bp, mouse
gggcccgggtggagcaggtc

SEQ ID NO: 830462 - DNA, 20 bp, mouse
gctgtcaagaggccagtctc

SEQ ID NO: 830463 - DNA, 20 bp, mouse
gcagacgtgaggcatgtcgg

SEQ ID NO: 830464 - DNA, 20 bp, mouse
gcaaagttctgtcagacctg

SEQ ID NO: 830465 - DNA, 20 bp, mouse
gggagcctctcacctggcag

SEQ ID NO: 830466 - DNA, 20 bp, mouse
gacacccccggctgtctgtc

SEQ ID NO: 830467 - DNA, 20 bp, mouse
ggctgtctgtccgggaacta

SEQ ID NO: 830468 - DNA, 20 bp, mouse
ggctccaggtgtctgttccg

SEQ ID NO: 830469 - DNA, 20 bp, mouse
gcgacctcggaacagacacc

SEQ ID NO: 830470 - DNA, 20 bp, mouse
ggctccacaagccaaaccag

SEQ ID NO: 830471 - DNA, 20 bp, mouse
gggggcggggcggacacccc

SEQ ID NO: 830472 - DNA, 20 bp, mouse
gtgccgggagcgccccctgc

SEQ ID NO: 830473 - DNA, 20 bp, mouse
gggtgcgtgttcttggccac

SEQ ID NO: 830474 - DNA, 20 bp, mouse
gttcccggacagacagccgg

SEQ ID NO: 830475 - DNA, 20 bp, mouse
gtcccggcagccttagttcc

SEQ ID NO: 830476 - DNA, 20 bp, mouse
gcatcctgcttatgcaagac

SEQ ID NO: 830477 - DNA, 20 bp, mouse
gaacatacccgtcacccaat

SEQ ID NO: 830478 - DNA, 20 bp, mouse
gaagcaggatgacctcccat

SEQ ID NO: 830479 - DNA, 20 bp, mouse
gatcccgggcacatgaactg

SEQ ID NO: 830480 - DNA, 20 bp, mouse
gtgcttatgcaagacgggct

SEQ ID NO: 830481 - DNA, 20 bp, mouse
ggtgaggtgagcatgtgggt

SEQ ID NO: 830482 - DNA, 20 bp, mouse
ggcccgggatgagggtaata

SEQ ID NO: 830483 - DNA, 20 bp, mouse
gatacccgtcacccaatggg

SEQ ID NO: 830484 - DNA, 20 bp, mouse
gtagccagcactggaactta

SEQ ID NO: 830485 - DNA, 20 bp, mouse
gtaattggggtgtgtaggag

SEQ ID NO: 830486 - DNA, 20 bp, mouse
gcagtggctgccaaggggcg

SEQ ID NO: 830487 - DNA, 20 bp, mouse
gtggggtcacagaagataca

SEQ ID NO: 830488 - DNA, 20 bp, mouse
gtctccaacatttcctcctg

SEQ ID NO: 830489 - DNA, 20 bp, mouse
ggtgctccttcctttgaagt

SEQ ID NO: 830490 - DNA, 20 bp, mouse
gtctgggggtcgcaggatcc

SEQ ID NO: 830491 - DNA, 20 bp, mouse
ggtccccaagcctcgcccct

SEQ ID NO: 830492 - DNA, 20 bp, mouse
gcaagatgagcctacttcaa

SEQ ID NO: 830493 - DNA, 20 bp, mouse
gatgagcctacttcaaagga

SEQ ID NO: 830494 - DNA, 20 bp, mouse
gtgccaaggggcgaggcttg

SEQ ID NO: 830495 - DNA, 20 bp, mouse
gtttcctcctggggctgata

SEQ ID NO: 830496 - DNA, 20 bp, mouse
gaggaactggtgaacagatg

SEQ ID NO: 830497 - DNA, 20 bp, mouse
ggggcagtggtgctatggtc

SEQ ID NO: 830498 - DNA, 20 bp, mouse
gtcagggagccaggaggaac

SEQ ID NO: 830499 - DNA, 20 bp, mouse
gaacagatggggcctccacg

SEQ ID NO: 830500 - DNA, 20 bp, mouse
gtcggagcctcggcatggaa

SEQ ID NO: 830501 - DNA, 20 bp, mouse
gccgaggctccgagagacac

SEQ ID NO: 830502 - DNA, 20 bp, mouse
gccgagagacactggaggtg

SEQ ID NO: 830503 - DNA, 20 bp, mouse
gacagagggctcaagtgcaa

SEQ ID NO: 830504 - DNA, 20 bp, mouse
ggcagtgttgcacagctgag

SEQ ID NO: 830505 - DNA, 20 bp, mouse
gagggctcaagtgcaagggc

SEQ ID NO: 830506 - DNA, 20 bp, mouse
gcctagaaggtgttcggcgt

SEQ ID NO: 830507 - DNA, 20 bp, mouse
gtgagctctcatgtacttga

SEQ ID NO: 830508 - DNA, 20 bp, mouse
gtaagcggaccagggagaat

SEQ ID NO: 830509 - DNA, 20 bp, mouse
gcctcaaccccatgtttcaa

SEQ ID NO: 830510 - DNA, 20 bp, mouse
gaatcacccagtaattgctt

SEQ ID NO: 830511 - DNA, 20 bp, mouse
ggggatgcgaatggtaagaa

SEQ ID NO: 830512 - DNA, 20 bp, mouse
ggcagaggatgtgaagtgat

SEQ ID NO: 830513 - DNA, 20 bp, mouse
gaaggtgttcggcgtgggag

SEQ ID NO: 830514 - DNA, 20 bp, mouse
gagtcatgatacctactcca

SEQ ID NO: 830515 - DNA, 20 bp, mouse
gcactcctaggcagtgaagt

SEQ ID NO: 830516 - DNA, 20 bp, mouse
gataaggagggcatccatcc

SEQ ID NO: 830517 - DNA, 20 bp, mouse
ggacaccaatcctccagctc

SEQ ID NO: 830518 - DNA, 20 bp, mouse
gatcctggagacaccagagc

SEQ ID NO: 830519 - DNA, 20 bp, mouse
gtggaggattggtgtcccag

SEQ ID NO: 830520 - DNA, 20 bp, mouse
gaacttcaggataacctcaa

SEQ ID NO: 830521 - DNA, 20 bp, mouse
gcaggtcctagccagggata

SEQ ID NO: 830522 - DNA, 20 bp, mouse
gaggttatcctgaagttagg

SEQ ID NO: 830523 - DNA, 20 bp, mouse
ggtcctagccagggataagg

SEQ ID NO: 830524 - DNA, 20 bp, mouse
gtgtttattcataagccagc

SEQ ID NO: 830525 - DNA, 20 bp, mouse
gaaggcaagtccctgctttt

SEQ ID NO: 830526 - DNA, 20 bp, mouse
gaggttggaaacacgagcag

SEQ ID NO: 830527 - DNA, 20 bp, mouse
gagcagcatcggcaacggag

SEQ ID NO: 830528 - DNA, 20 bp, mouse
gcctggatacagccaagaaa

SEQ ID NO: 830529 - DNA, 20 bp, mouse
ggcatcggcaacggagaggt

SEQ ID NO: 830530 - DNA, 20 bp, mouse
ggggccctctgaatttacca

SEQ ID NO: 830531 - DNA, 20 bp, mouse
gagcagaggatgcgacaaag

SEQ ID NO: 830532 - DNA, 20 bp, mouse
ggcccaacaggggcgtggtg

SEQ ID NO: 830533 - DNA, 20 bp, mouse
gaatgtgtttgcttctagat

SEQ ID NO: 830534 - DNA, 20 bp, mouse
gaaggcgacgcagcacctgc

SEQ ID NO: 830535 - DNA, 20 bp, mouse
ggcttatgatgtagggtcgt

SEQ ID NO: 830536 - DNA, 20 bp, mouse
gccgggagaagcagacacgc

SEQ ID NO: 830537 - DNA, 20 bp, mouse
gcacctgacaagaaagtcac

SEQ ID NO: 830538 - DNA, 20 bp, mouse
gacagcatggagaagtccat

SEQ ID NO: 830539 - DNA, 20 bp, mouse
gcagaggccgggaactagtc

SEQ ID NO: 830540 - DNA, 20 bp, mouse
gggcgacctcggcagctggt

SEQ ID NO: 830541 - DNA, 20 bp, mouse
ggacggtcctacacccaatg

SEQ ID NO: 830542 - DNA, 20 bp, mouse
gtgccgccgaccagctgccg

SEQ ID NO: 830543 - DNA, 20 bp, mouse
gaggacaccacgcctgctac

SEQ ID NO: 830544 - DNA, 20 bp, mouse
gttcctgtgactttcttgtc

SEQ ID NO: 830545 - DNA, 20 bp, mouse
gtaactgcctgagaggaaga

SEQ ID NO: 830546 - DNA, 20 bp, mouse
ggggaagactgtcctagtgt

SEQ ID NO: 830547 - DNA, 20 bp, mouse
gtaaacccaagacccacact

SEQ ID NO: 830548 - DNA, 20 bp, mouse
gaagtcacctgctggaggtc

SEQ ID NO: 830549 - DNA, 20 bp, mouse
gactctgactcctccttgtg

SEQ ID NO: 830550 - DNA, 20 bp, mouse
gccttagctagaaaactctc

SEQ ID NO: 830551 - DNA, 20 bp, mouse
ggcttgcttgcattcttggt

SEQ ID NO: 830552 - DNA, 20 bp, mouse
gcccaaaatattaacttttt

SEQ ID NO: 830553 - DNA, 20 bp, mouse
gccaagctgttctgcccctc

SEQ ID NO: 830554 - DNA, 20 bp, mouse
gctgtcctagtgtgggtctt

SEQ ID NO: 830555 - DNA, 20 bp, mouse
gactaggacagtcttcccag

SEQ ID NO: 830556 - DNA, 20 bp, mouse
gcctctgtgggcccctggtg

SEQ ID NO: 830557 - DNA, 20 bp, mouse
gaatagggcggtagattgta

SEQ ID NO: 830558 - DNA, 20 bp, mouse
gagaaagagagtgaataggg

SEQ ID NO: 830559 - DNA, 20 bp, mouse
gctggagaaaatgcctcacc

SEQ ID NO: 830560 - DNA, 20 bp, mouse
gctgtaatcagagtaggttt

SEQ ID NO: 830561 - DNA, 20 bp, mouse
gggtagattgtagggtagaa

SEQ ID NO: 830562 - DNA, 20 bp, mouse
ggggcatgggaagggtagtt

SEQ ID NO: 830563 - DNA, 20 bp, mouse
gggaaagaaagagagtgaat

SEQ ID NO: 830564 - DNA, 20 bp, mouse
gaagggagatgagaggagaa

SEQ ID NO: 830565 - DNA, 20 bp, mouse
ggtagaaggggagaggagaa

SEQ ID NO: 830566 - DNA, 20 bp, mouse
ggggcacagagcgagggcga

SEQ ID NO: 830567 - DNA, 20 bp, mouse
gcgagggcgacggacgagag

SEQ ID NO: 830568 - DNA, 20 bp, mouse
gagggcggagggtgattcag

SEQ ID NO: 830569 - DNA, 20 bp, mouse
gaggcaggtgcctgcgacag

SEQ ID NO: 830570 - DNA, 20 bp, mouse
gaggatgcgcaggaggtagg

SEQ ID NO: 830571 - DNA, 20 bp, mouse
gcccatgctggattacccaa

SEQ ID NO: 830572 - DNA, 20 bp, mouse
gacgacatgaagacaggggc

SEQ ID NO: 830573 - DNA, 20 bp, mouse
gaggcacagcaggcgtggag

SEQ ID NO: 830574 - DNA, 20 bp, mouse
gtgggcgctcccatatgccc

SEQ ID NO: 830575 - DNA, 20 bp, mouse
gtggatgcaattagatctaa

SEQ ID NO: 830576 - DNA, 20 bp, mouse
gggcaagcccggggcactat

SEQ ID NO: 830577 - DNA, 20 bp, mouse
gaccccgcgcggacctgaac

SEQ ID NO: 830578 - DNA, 20 bp, mouse
gacaactctcagcatgctgc

SEQ ID NO: 830579 - DNA, 20 bp, mouse
gtgtaaaatgaggaccgtga

SEQ ID NO: 830580 - DNA, 20 bp, mouse
gttgtgttccgttgttccaa

SEQ ID NO: 830581 - DNA, 20 bp, mouse
ggacctgaactgggcaagcc

SEQ ID NO: 830582 - DNA, 20 bp, mouse
ggcccagttcaggtccgcgc

SEQ ID NO: 830583 - DNA, 20 bp, mouse
gggaccgtgagggactggag

SEQ ID NO: 830584 - DNA, 20 bp, mouse
gaatgtataaaactccagag

SEQ ID NO: 830585 - DNA, 20 bp, mouse
gtccaaaatctcctagcctt

SEQ ID NO: 830586 - DNA, 20 bp, mouse
gtcccagcagtcaccatcat

SEQ ID NO: 830587 - DNA, 20 bp, mouse
gctgacacctagaggtgtgg

SEQ ID NO: 830588 - DNA, 20 bp, mouse
gtcaaagagggcgtttgcga

SEQ ID NO: 830589 - DNA, 20 bp, mouse
gcagcagcctccacacctct

SEQ ID NO: 830590 - DNA, 20 bp, mouse
gctcggggacggttgtgcca

SEQ ID NO: 830591 - DNA, 20 bp, mouse
gtgctctgccagccagaagg

SEQ ID NO: 830592 - DNA, 20 bp, mouse
gcacggaaatatcgcgagag

SEQ ID NO: 830593 - DNA, 20 bp, mouse
ggctcctccaatcagaagtg

SEQ ID NO: 830594 - DNA, 20 bp, mouse
gggcctgacacctagaggtg

SEQ ID NO: 830595 - DNA, 20 bp, mouse
gggacggttgtgccagggac

SEQ ID NO: 830596 - DNA, 20 bp, mouse
gcagcagtgcggaagtgggt

SEQ ID NO: 830597 - DNA, 20 bp, mouse
ggggccctctgcgccttggc

SEQ ID NO: 830598 - DNA, 20 bp, mouse
gtcccagggaagctgaccat

SEQ ID NO: 830599 - DNA, 20 bp, mouse
gggaagctgaccattggctg

SEQ ID NO: 830600 - DNA, 20 bp, mouse
ggtggtcagcagtgcggaag

SEQ ID NO: 830601 - DNA, 20 bp, mouse
gtcggctcgccgtctctgat

SEQ ID NO: 830602 - DNA, 20 bp, mouse
gggggcgaggcgcgcctgtg

SEQ ID NO: 830603 - DNA, 20 bp, mouse
ggaagagagcgcgtttgttt

SEQ ID NO: 830604 - DNA, 20 bp, mouse
gcgcgcctcgccccagccaa

SEQ ID NO: 830605 - DNA, 20 bp, mouse
gtacgagaacgactgcagtc

SEQ ID NO: 830606 - DNA, 20 bp, mouse
ggactctgaacaggatatcg

SEQ ID NO: 830607 - DNA, 20 bp, mouse
gtgcgcttcggagtcggccc

SEQ ID NO: 830608 - DNA, 20 bp, mouse
ggctacccttcacaaggatc

SEQ ID NO: 830609 - DNA, 20 bp, mouse
ggcaccaaaacgttcttctg

SEQ ID NO: 830610 - DNA, 20 bp, mouse
gcgcccggcgcagtcgtccc

SEQ ID NO: 830611 - DNA, 20 bp, mouse
ggcagcgcctcctaaaggag

SEQ ID NO: 830612 - DNA, 20 bp, mouse
gcggccgtccgcctgcgctt

SEQ ID NO: 830613 - DNA, 20 bp, mouse
gcccggaagtgagaggcttc

SEQ ID NO: 830614 - DNA, 20 bp, mouse
gcggcccgggacgactgcgc

SEQ ID NO: 830615 - DNA, 20 bp, mouse
ggtaagaggtagctgagagt

SEQ ID NO: 830616 - DNA, 20 bp, mouse
gacgctggacctagtctctt

SEQ ID NO: 830617 - DNA, 20 bp, mouse
gggaccccgggaggtagggg

SEQ ID NO: 830618 - DNA, 20 bp, mouse
gagaaagcctctgtagaagg

SEQ ID NO: 830619 - DNA, 20 bp, mouse
ggggcccccgtctgagacgc

SEQ ID NO: 830620 - DNA, 20 bp, mouse
gggcgtgcacagtaccgggg

SEQ ID NO: 830621 - DNA, 20 bp, mouse
gcccgcctgccacctcggac

SEQ ID NO: 830622 - DNA, 20 bp, mouse
gagcgagagagagcgatctg

SEQ ID NO: 830623 - DNA, 20 bp, mouse
gtaagactgcagggacacaa

SEQ ID NO: 830624 - DNA, 20 bp, mouse
gacctcggacgggatgctag

SEQ ID NO: 830625 - DNA, 20 bp, mouse
gaggggacagttaagactgc

SEQ ID NO: 830626 - DNA, 20 bp, mouse
gcctaactcagctaagtttc

SEQ ID NO: 830627 - DNA, 20 bp, mouse
ggggcggggtccgcaggctc

SEQ ID NO: 830628 - DNA, 20 bp, mouse
gcctgcggaccccgcccctc

SEQ ID NO: 830629 - DNA, 20 bp, mouse
ggtgcccaagtaaacaactt

SEQ ID NO: 830630 - DNA, 20 bp, mouse
gcagacaagtgcggggtaga

SEQ ID NO: 830631 - DNA, 20 bp, mouse
ggagccgccatcttttttag

SEQ ID NO: 830632 - DNA, 20 bp, mouse
gcttgggcacaagttgtagg

SEQ ID NO: 830633 - DNA, 20 bp, mouse
ggctctgtacctgtctgtaa

SEQ ID NO: 830634 - DNA, 20 bp, mouse
gcaaagggccctaatggctg

SEQ ID NO: 830635 - DNA, 20 bp, mouse
gcctaaagaagttagagctg

SEQ ID NO: 830636 - DNA, 20 bp, mouse
gccgccgcttcggaacaccc

SEQ ID NO: 830637 - DNA, 20 bp, mouse
gggcccgagctgcgctcctc

SEQ ID NO: 830638 - DNA, 20 bp, mouse
gcccgctgcggccgcgacgc

SEQ ID NO: 830639 - DNA, 20 bp, mouse
gtgtctgtacggaaagatgg

SEQ ID NO: 830640 - DNA, 20 bp, mouse
ggggcggaggccggtgtgtt

SEQ ID NO: 830641 - DNA, 20 bp, mouse
gctcccgtggccgcccgctg

SEQ ID NO: 830642 - DNA, 20 bp, mouse
gcggacgcctgccctgtcgc

SEQ ID NO: 830643 - DNA, 20 bp, mouse
gggacagggaagatggacgc

SEQ ID NO: 830644 - DNA, 20 bp, mouse
gtcgccatctcgccgtacgg

SEQ ID NO: 830645 - DNA, 20 bp, mouse
ggtaccgagacatgcgcggg

SEQ ID NO: 830646 - DNA, 20 bp, mouse
ggggcgggccaccggatgtt

SEQ ID NO: 830647 - DNA, 20 bp, mouse
gccaccggatgttgggagtg

SEQ ID NO: 830648 - DNA, 20 bp, mouse
gccgtggcgcgggcccccaa

SEQ ID NO: 830649 - DNA, 20 bp, mouse
gggaccggaagagatcctgg

SEQ ID NO: 830650 - DNA, 20 bp, mouse
ggaacgagctaggacaagac

SEQ ID NO: 830651 - DNA, 20 bp, mouse
gtgtgcgcgtacgttgttca

SEQ ID NO: 830652 - DNA, 20 bp, mouse
gggtggtgggcggcagtcgg

SEQ ID NO: 830653 - DNA, 20 bp, mouse
ggccccgccaggatctcttc

SEQ ID NO: 830654 - DNA, 20 bp, mouse
gggagtctatagaacgagct

SEQ ID NO: 830655 - DNA, 20 bp, mouse
gactccgtcgcccgtggcgc

SEQ ID NO: 830656 - DNA, 20 bp, mouse
gccccgaggcgggaccaagg

SEQ ID NO: 830657 - DNA, 20 bp, mouse
gaagccagcaggaacgcagg

SEQ ID NO: 830658 - DNA, 20 bp, mouse
gggcctgggaagccgcctga

SEQ ID NO: 830659 - DNA, 20 bp, mouse
gggagcaaataaagaagcga

SEQ ID NO: 830660 - DNA, 20 bp, mouse
gctgaagccagcaggaacgc

SEQ ID NO: 830661 - DNA, 20 bp, mouse
gcggggcttccggaccaggc

SEQ ID NO: 830662 - DNA, 20 bp, mouse
gttcccaggcccgcctggtc

SEQ ID NO: 830663 - DNA, 20 bp, mouse
gaggccccgaggcgggacca

SEQ ID NO: 830664 - DNA, 20 bp, mouse
gtccggaagccccgccccct

SEQ ID NO: 830665 - DNA, 20 bp, mouse
gggcagagaagcccggagtt

SEQ ID NO: 830666 - DNA, 20 bp, mouse
gatcgcgcagaggtgatccc

SEQ ID NO: 830667 - DNA, 20 bp, mouse
gagggcgggcgcaaggcgtc

SEQ ID NO: 830668 - DNA, 20 bp, mouse
gtgggcgttgggaggccctc

SEQ ID NO: 830669 - DNA, 20 bp, mouse
ggggctataccggagagtct

SEQ ID NO: 830670 - DNA, 20 bp, mouse
gataccggagagtctggggc

SEQ ID NO: 830671 - DNA, 20 bp, mouse
gcgcagaggtgatcccaggc

SEQ ID NO: 830672 - DNA, 20 bp, mouse
gaaaaagtctgtctgggcgt

SEQ ID NO: 830673 - DNA, 20 bp, mouse
gactctccggtatagcccgc

SEQ ID NO: 830674 - DNA, 20 bp, mouse
ggctgcgttctcggattact

SEQ ID NO: 830675 - DNA, 20 bp, mouse
gctgacacagttctgttctg

SEQ ID NO: 830676 - DNA, 20 bp, mouse
gtacgccaaggctgcgtggg

SEQ ID NO: 830677 - DNA, 20 bp, mouse
gctaaaggctgagtacgcca

SEQ ID NO: 830678 - DNA, 20 bp, mouse
gctcgggctgaaagtgaagg

SEQ ID NO: 830679 - DNA, 20 bp, mouse
ggagtacgccaaggctgcgt

SEQ ID NO: 830680 - DNA, 20 bp, mouse
gggagactccgatcccgcac

SEQ ID NO: 830681 - DNA, 20 bp, mouse
gtgcttggcgcacagctctc

SEQ ID NO: 830682 - DNA, 20 bp, mouse
ggctctcgggctgaaagtga

SEQ ID NO: 830683 - DNA, 20 bp, mouse
gcaaagaagcatcgcgtctg

SEQ ID NO: 830684 - DNA, 20 bp, mouse
gcgatcccgcacaggagccc

SEQ ID NO: 830685 - DNA, 20 bp, mouse
ggaggggggagggttctcgg

SEQ ID NO: 830686 - DNA, 20 bp, mouse
gggaggggcgttagctctga

SEQ ID NO: 830687 - DNA, 20 bp, mouse
gcctgggtggacctgtagga

SEQ ID NO: 830688 - DNA, 20 bp, mouse
gtcctccccgggcccctgtc

SEQ ID NO: 830689 - DNA, 20 bp, mouse
gaaagcctgggtggacctgt

SEQ ID NO: 830690 - DNA, 20 bp, mouse
ggacaggcctcctggggaaa

SEQ ID NO: 830691 - DNA, 20 bp, mouse
ggcccctgtctggaaagcct

SEQ ID NO: 830692 - DNA, 20 bp, mouse
gccacccaggctttccagac

SEQ ID NO: 830693 - DNA, 20 bp, mouse
ggaggggctggatttggact

SEQ ID NO: 830694 - DNA, 20 bp, mouse
gtccagacaggggcccgggg

SEQ ID NO: 830695 - DNA, 20 bp, mouse
ggagctaacgcccctcctac

SEQ ID NO: 830696 - DNA, 20 bp, mouse
gggactgaggagcgagctgg

SEQ ID NO: 830697 - DNA, 20 bp, mouse
gcaggaggcaaggaaagctc

SEQ ID NO: 830698 - DNA, 20 bp, mouse
ggggagggaaaaagactagg

SEQ ID NO: 830699 - DNA, 20 bp, mouse
gggagccggtgatgcctcca

SEQ ID NO: 830700 - DNA, 20 bp, mouse
gctaaagggaagcatctttg

SEQ ID NO: 830701 - DNA, 20 bp, mouse
gtatggtggagcaggaggca

SEQ ID NO: 830702 - DNA, 20 bp, mouse
ggaggggggcggagggactg

SEQ ID NO: 830703 - DNA, 20 bp, mouse
gctcccaagaaccagatgtc

SEQ ID NO: 830704 - DNA, 20 bp, mouse
ggagctgccaatcaccttgg

SEQ ID NO: 830705 - DNA, 20 bp, mouse
gaaccagatgtcaggctaaa

SEQ ID NO: 830706 - DNA, 20 bp, mouse
ggggccaccgagggaaacgc

SEQ ID NO: 830707 - DNA, 20 bp, mouse
ggtgtggagaccagacggaa

SEQ ID NO: 830708 - DNA, 20 bp, mouse
gcgggagcgtgggccaccga

SEQ ID NO: 830709 - DNA, 20 bp, mouse
gcggcgggaaccgggagcgt

SEQ ID NO: 830710 - DNA, 20 bp, mouse
gaccgagggaaacgctggtg

SEQ ID NO: 830711 - DNA, 20 bp, mouse
gagcggggacggcgggaacc

SEQ ID NO: 830712 - DNA, 20 bp, mouse
ggaccagacggaatggaatg

SEQ ID NO: 830713 - DNA, 20 bp, mouse
gggggaggaccgagtcaggg

SEQ ID NO: 830714 - DNA, 20 bp, mouse
gcggctggaccataaagcgc

SEQ ID NO: 830715 - DNA, 20 bp, mouse
gcacctcattccattccgtc

SEQ ID NO: 830716 - DNA, 20 bp, mouse
gtccaaaagaaagacacgaa

SEQ ID NO: 830717 - DNA, 20 bp, mouse
ggggcctcggaatccatggg

SEQ ID NO: 830718 - DNA, 20 bp, mouse
gccaacactgggatggaatg

SEQ ID NO: 830719 - DNA, 20 bp, mouse
gtgggagacaagaggcgaca

SEQ ID NO: 830720 - DNA, 20 bp, mouse
ggtgtgcccctccagtgggt

SEQ ID NO: 830721 - DNA, 20 bp, mouse
gcgtgtctttcttttggagt

SEQ ID NO: 830722 - DNA, 20 bp, mouse
gaaaagaaagacacgaaggg

SEQ ID NO: 830723 - DNA, 20 bp, mouse
gcctccagtgggtgggttta

SEQ ID NO: 830724 - DNA, 20 bp, mouse
gaagggtgtgcccctccagt

SEQ ID NO: 830725 - DNA, 20 bp, mouse
gagtgttggagctaagtctg

SEQ ID NO: 830726 - DNA, 20 bp, mouse
gtgcgccagtgcagtaaccg

SEQ ID NO: 830727 - DNA, 20 bp, mouse
gagtcggcgtgtggatagtg

SEQ ID NO: 830728 - DNA, 20 bp, mouse
gtcagccacggttactgcac

SEQ ID NO: 830729 - DNA, 20 bp, mouse
gctggcgcctctccgaatcc

SEQ ID NO: 830730 - DNA, 20 bp, mouse
gtgcgtccggctctcagcca

SEQ ID NO: 830731 - DNA, 20 bp, mouse
ggtgaacaaggaactaaact

SEQ ID NO: 830732 - DNA, 20 bp, mouse
gcgcgcgccgcccacagtgc

SEQ ID NO: 830733 - DNA, 20 bp, mouse
gagtggataaccactaggtg

SEQ ID NO: 830734 - DNA, 20 bp, mouse
gggagaggcgccagcactgt

SEQ ID NO: 830735 - DNA, 20 bp, mouse
gagccggacgcaaaatctcc

SEQ ID NO: 830736 - DNA, 20 bp, mouse
gaggcagggctgggtttctg

SEQ ID NO: 830737 - DNA, 20 bp, mouse
gcccacctacagatcccgac

SEQ ID NO: 830738 - DNA, 20 bp, mouse
ggagacctagaggcagggct

SEQ ID NO: 830739 - DNA, 20 bp, mouse
gccctgcccagtgttgggga

SEQ ID NO: 830740 - DNA, 20 bp, mouse
ggcacaagccacagtccctg

SEQ ID NO: 830741 - DNA, 20 bp, mouse
ggtggggaggggctgcctca

SEQ ID NO: 830742 - DNA, 20 bp, mouse
gacctgtcgggatctgtagg

SEQ ID NO: 830743 - DNA, 20 bp, mouse
ggtcttgttagaatctagac

SEQ ID NO: 830744 - DNA, 20 bp, mouse
gaattcggggatagatagtg

SEQ ID NO: 830745 - DNA, 20 bp, mouse
gcctgtgcacaaaggagggt

SEQ ID NO: 830746 - DNA, 20 bp, mouse
gcccctgcgcgcgtcctcga

SEQ ID NO: 830747 - DNA, 20 bp, mouse
gcctctggagtactccccct

SEQ ID NO: 830748 - DNA, 20 bp, mouse
gcgtcctcgatggcctagtc

SEQ ID NO: 830749 - DNA, 20 bp, mouse
gccaggggccgtgcagaaat

SEQ ID NO: 830750 - DNA, 20 bp, mouse
ggtacagcgccacctggcta

SEQ ID NO: 830751 - DNA, 20 bp, mouse
ggccgagcgccgtagccagg

SEQ ID NO: 830752 - DNA, 20 bp, mouse
ggacccagactaggccatcg

SEQ ID NO: 830753 - DNA, 20 bp, mouse
gtctgggtcctctgcgttag

SEQ ID NO: 830754 - DNA, 20 bp, mouse
gagcggctttcgcttttctc

SEQ ID NO: 830755 - DNA, 20 bp, mouse
gtgcaggtgcaagagtgaca

SEQ ID NO: 830756 - DNA, 20 bp, mouse
gagaataggcaggagacagt

SEQ ID NO: 830757 - DNA, 20 bp, mouse
ggtggcatgaacactggaca

SEQ ID NO: 830758 - DNA, 20 bp, mouse
ggtaggacagccctaaggtg

SEQ ID NO: 830759 - DNA, 20 bp, mouse
ggggcaaacagctcaagcag

SEQ ID NO: 830760 - DNA, 20 bp, mouse
gcaagtacctccccacctta

SEQ ID NO: 830761 - DNA, 20 bp, mouse
gttgccaacctcattacttt

SEQ ID NO: 830762 - DNA, 20 bp, mouse
gctagaacccagatgcagag

SEQ ID NO: 830763 - DNA, 20 bp, mouse
gtcggggtaggacagcccta

SEQ ID NO: 830764 - DNA, 20 bp, mouse
gaatgggagccaatcggggt

SEQ ID NO: 830765 - DNA, 20 bp, mouse
gctggacatggccagaatgc

SEQ ID NO: 830766 - DNA, 20 bp, mouse
gcgcttcagagaaccctgta

SEQ ID NO: 830767 - DNA, 20 bp, mouse
ggaggccacgcccctcaggt

SEQ ID NO: 830768 - DNA, 20 bp, mouse
gcgccccgaactcttgaatg

SEQ ID NO: 830769 - DNA, 20 bp, mouse
gtcaggtcgggagccctaca

SEQ ID NO: 830770 - DNA, 20 bp, mouse
gaagtccccattcaagagtt

SEQ ID NO: 830771 - DNA, 20 bp, mouse
gggcccagcccatagggtgt

SEQ ID NO: 830772 - DNA, 20 bp, mouse
gggcactacctacaccctat

SEQ ID NO: 830773 - DNA, 20 bp, mouse
gtacaactctgggatcacag

SEQ ID NO: 830774 - DNA, 20 bp, mouse
ggctcccgacctgaggggcg

SEQ ID NO: 830775 - DNA, 20 bp, mouse
gcagcttgcagaggacagtc

SEQ ID NO: 830776 - DNA, 20 bp, mouse
gtcattggttcaatgactga

SEQ ID NO: 830777 - DNA, 20 bp, mouse
gagccacctgatcatgactc

SEQ ID NO: 830778 - DNA, 20 bp, mouse
ggtagggcacctgactcttt

SEQ ID NO: 830779 - DNA, 20 bp, mouse
ggtgactaggccccaccttc

SEQ ID NO: 830780 - DNA, 20 bp, mouse
gggcacctgactcttttggt

SEQ ID NO: 830781 - DNA, 20 bp, mouse
gcgccaggaagaaggttcat

SEQ ID NO: 830782 - DNA, 20 bp, mouse
gggttcaatgactgagggct

SEQ ID NO: 830783 - DNA, 20 bp, mouse
ggatgtataggacactgctt

SEQ ID NO: 830784 - DNA, 20 bp, mouse
gagaggctcgacagaaatgc

SEQ ID NO: 830785 - DNA, 20 bp, mouse
gacgtgtcacaggggaaaag

SEQ ID NO: 830786 - DNA, 20 bp, mouse
gtgcctacggggtaacagac

SEQ ID NO: 830787 - DNA, 20 bp, mouse
gctgccaggcgtgttcttct

SEQ ID NO: 830788 - DNA, 20 bp, mouse
gacagcgacaggaacttccg

SEQ ID NO: 830789 - DNA, 20 bp, mouse
gtgcctgtctgttaccccgt

SEQ ID NO: 830790 - DNA, 20 bp, mouse
gtggcagccagctgagttga

SEQ ID NO: 830791 - DNA, 20 bp, mouse
gcgacaggaacttccggggt

SEQ ID NO: 830792 - DNA, 20 bp, mouse
gggcgtgttcttctgggctg

SEQ ID NO: 830793 - DNA, 20 bp, mouse
ggcttccttatggcgaatgt

SEQ ID NO: 830794 - DNA, 20 bp, mouse
gcccgtccattgcttcctta

SEQ ID NO: 830795 - DNA, 20 bp, mouse
gagagccgctctagccacgg

SEQ ID NO: 830796 - DNA, 20 bp, mouse
gcggaggtggagcgatcgac

SEQ ID NO: 830797 - DNA, 20 bp, mouse
gtggagcgatcgacggggaa

SEQ ID NO: 830798 - DNA, 20 bp, mouse
gaggggcgcggcctgaatgt

SEQ ID NO: 830799 - DNA, 20 bp, mouse
gagagaaggagttgagacag

SEQ ID NO: 830800 - DNA, 20 bp, mouse
gcgccccgcccattaccccg

SEQ ID NO: 830801 - DNA, 20 bp, mouse
gggaggagcctcggggtaat

SEQ ID NO: 830802 - DNA, 20 bp, mouse
gggtaatgggcggggcgtct

SEQ ID NO: 830803 - DNA, 20 bp, mouse
ggagcctcggggtaatgggc

SEQ ID NO: 830804 - DNA, 20 bp, mouse
ggggaaggggaggagcctcg

SEQ ID NO: 830805 - DNA, 20 bp, mouse
ggcggggcgtctgggttacg

SEQ ID NO: 830806 - DNA, 20 bp, mouse
gtggagaagggacttcgggg

SEQ ID NO: 830807 - DNA, 20 bp, mouse
gagagaatccagagtctgaa

SEQ ID NO: 830808 - DNA, 20 bp, mouse
gctcctacagagggcggagg

SEQ ID NO: 830809 - DNA, 20 bp, mouse
gaacacaaaggctagtgttc

SEQ ID NO: 830810 - DNA, 20 bp, mouse
gaggcactcattgaacacaa

SEQ ID NO: 830811 - DNA, 20 bp, mouse
gggggaggagctcctacaga

SEQ ID NO: 830812 - DNA, 20 bp, mouse
gaagacagagcttggaagac

SEQ ID NO: 830813 - DNA, 20 bp, mouse
gcaggagtaggggggtcggg

SEQ ID NO: 830814 - DNA, 20 bp, mouse
ggaaagggatgtgcaaagac

SEQ ID NO: 830815 - DNA, 20 bp, mouse
gagacaggagtaggggggtc

SEQ ID NO: 830816 - DNA, 20 bp, mouse
gggccagcggtgaagatctc

SEQ ID NO: 830817 - DNA, 20 bp, mouse
gtttcctagagggtgaatga

SEQ ID NO: 830818 - DNA, 20 bp, mouse
gtcgcgagaagccgcagaag

SEQ ID NO: 830819 - DNA, 20 bp, mouse
gtcaaagcaagccacttctg

SEQ ID NO: 830820 - DNA, 20 bp, mouse
gcaaggctggttttcctaga

SEQ ID NO: 830821 - DNA, 20 bp, mouse
ggcggtgaagatctccggtg

SEQ ID NO: 830822 - DNA, 20 bp, mouse
gcaacggctagagtggccag

SEQ ID NO: 830823 - DNA, 20 bp, mouse
ggggagcaaagagacggcaa

SEQ ID NO: 830824 - DNA, 20 bp, mouse
gtgacaacacgaaacaccct

SEQ ID NO: 830825 - DNA, 20 bp, mouse
gtctgggactccactagcag

SEQ ID NO: 830826 - DNA, 20 bp, mouse
gcaaacggaagtcctgggcc

SEQ ID NO: 830827 - DNA, 20 bp, mouse
gcccgagcgcggggtcaaag

SEQ ID NO: 830828 - DNA, 20 bp, mouse
gtggcttggggtagagatta

SEQ ID NO: 830829 - DNA, 20 bp, mouse
gcccaccaaacggaagtcct

SEQ ID NO: 830830 - DNA, 20 bp, mouse
gcgccgcccacggggagtga

SEQ ID NO: 830831 - DNA, 20 bp, mouse
gctgggccaggccgacaaag

SEQ ID NO: 830832 - DNA, 20 bp, mouse
gtgacggaagctgcgaactc

SEQ ID NO: 830833 - DNA, 20 bp, mouse
gaggccgacaaagaggtggc

SEQ ID NO: 830834 - DNA, 20 bp, mouse
gagattacgggagatcataa

SEQ ID NO: 830835 - DNA, 20 bp, mouse
gcactcggtctgttaggcat

SEQ ID NO: 830836 - DNA, 20 bp, mouse
gtggacgcgcgctgcatggc

SEQ ID NO: 830837 - DNA, 20 bp, mouse
gccggggccgctctggccga

SEQ ID NO: 830838 - DNA, 20 bp, mouse
ggaggggcccaggaccgcag

SEQ ID NO: 830839 - DNA, 20 bp, mouse
gaagctggatactctgagtc

SEQ ID NO: 830840 - DNA, 20 bp, mouse
gggcgcgcggtccgtgagga

SEQ ID NO: 830841 - DNA, 20 bp, mouse
ggcgcggtccgtgaggaggg

SEQ ID NO: 830842 - DNA, 20 bp, mouse
ggagcgacgcggcgcttttt

SEQ ID NO: 830843 - DNA, 20 bp, mouse
gcggcgcccgctgcggtcct

SEQ ID NO: 830844 - DNA, 20 bp, mouse
gcagagcggccccggctcga

SEQ ID NO: 830845 - DNA, 20 bp, mouse
ggcgccgcgtcgctccgcgc

SEQ ID NO: 830846 - DNA, 20 bp, mouse
gcaccggagtgtgaattagt

SEQ ID NO: 830847 - DNA, 20 bp, mouse
gggcccactaattcacactc

SEQ ID NO: 830848 - DNA, 20 bp, mouse
gcactcgagtgagtcggcgg

SEQ ID NO: 830849 - DNA, 20 bp, mouse
gactcactcgagtgagtcgg

SEQ ID NO: 830850 - DNA, 20 bp, mouse
gcaaactcactcgagtgagt

SEQ ID NO: 830851 - DNA, 20 bp, mouse
gagtctagttctattaagtt

SEQ ID NO: 830852 - DNA, 20 bp, mouse
ggctgtgctatcatttgaac

SEQ ID NO: 830853 - DNA, 20 bp, mouse
ggtgcttcgtgccccttcac

SEQ ID NO: 830854 - DNA, 20 bp, mouse
ggcaagtgtgctatgtagtg

SEQ ID NO: 830855 - DNA, 20 bp, mouse
gtaattcacactccggtgaa

SEQ ID NO: 830856 - DNA, 20 bp, mouse
gggcccgtgggtcccgactt

SEQ ID NO: 830857 - DNA, 20 bp, mouse
gggagcgaggtcccccaagt

SEQ ID NO: 830858 - DNA, 20 bp, mouse
gagggcgtggtacagcgcga

SEQ ID NO: 830859 - DNA, 20 bp, mouse
gtcagggtcctgcagataga

SEQ ID NO: 830860 - DNA, 20 bp, mouse
gtaaacgccaggtgtgtaat

SEQ ID NO: 830861 - DNA, 20 bp, mouse
gggacaggtcggcgcggtgg

SEQ ID NO: 830862 - DNA, 20 bp, mouse
gaggccgcgagttaccccag

SEQ ID NO: 830863 - DNA, 20 bp, mouse
gagggcaggagttttggctg

SEQ ID NO: 830864 - DNA, 20 bp, mouse
gccaccactggggtaactcg

SEQ ID NO: 830865 - DNA, 20 bp, mouse
ggaaagtggggaggcgattc

SEQ ID NO: 830866 - DNA, 20 bp, mouse
gcagcccgaagctcacctgg

SEQ ID NO: 830867 - DNA, 20 bp, mouse
gcgcgctcgccgctctcctg

SEQ ID NO: 830868 - DNA, 20 bp, mouse
ggctccgcgccccaggagag

SEQ ID NO: 830869 - DNA, 20 bp, mouse
ggggtgaagggcgagacggg

SEQ ID NO: 830870 - DNA, 20 bp, mouse
gccaccggagcgcacggtcg

SEQ ID NO: 830871 - DNA, 20 bp, mouse
gggcgggtgaagggcgagac

SEQ ID NO: 830872 - DNA, 20 bp, mouse
gggagcggccggcgggtgaa

SEQ ID NO: 830873 - DNA, 20 bp, mouse
ggcgactcaaaagtcggaga

SEQ ID NO: 830874 - DNA, 20 bp, mouse
gctggccgcggcctccaggg

SEQ ID NO: 830875 - DNA, 20 bp, mouse
gcagccgccaggtgagcttc

SEQ ID NO: 830876 - DNA, 20 bp, mouse
gacacagtggagcccgcaat

SEQ ID NO: 830877 - DNA, 20 bp, mouse
gggcaagctcgggataatgt

SEQ ID NO: 830878 - DNA, 20 bp, mouse
gagctccgagcacgctagga

SEQ ID NO: 830879 - DNA, 20 bp, mouse
gtggctgtcataggtgagtg

SEQ ID NO: 830880 - DNA, 20 bp, mouse
ggcccgcaattggctgtcat

SEQ ID NO: 830881 - DNA, 20 bp, mouse
gtgcgcaggaacaaccagtc

SEQ ID NO: 830882 - DNA, 20 bp, mouse
gccactgacagggcaagctc

SEQ ID NO: 830883 - DNA, 20 bp, mouse
gcacctatgacagccaattg

SEQ ID NO: 830884 - DNA, 20 bp, mouse
gcagcatcctggcgttccga

SEQ ID NO: 830885 - DNA, 20 bp, mouse
gaacgcgagtgtgcatgcgc

SEQ ID NO: 830886 - DNA, 20 bp, mouse
gggctctagtcccagtagac

SEQ ID NO: 830887 - DNA, 20 bp, mouse
gagccaccaagcccaggtga

SEQ ID NO: 830888 - DNA, 20 bp, mouse
gtccgggggagccttcacct

SEQ ID NO: 830889 - DNA, 20 bp, mouse
ggggctctattcatggacca

SEQ ID NO: 830890 - DNA, 20 bp, mouse
gaggagctgggctctattca

SEQ ID NO: 830891 - DNA, 20 bp, mouse
gtggaccatggtccagccat

SEQ ID NO: 830892 - DNA, 20 bp, mouse
gctctctgattgggcggaag

SEQ ID NO: 830893 - DNA, 20 bp, mouse
gggcagaatacggttctctc

SEQ ID NO: 830894 - DNA, 20 bp, mouse
gacttcttttcctgtctact

SEQ ID NO: 830895 - DNA, 20 bp, mouse
gggctctctgctctctgatt

SEQ ID NO: 830896 - DNA, 20 bp, mouse
ggggaccggcgactgcgagg

SEQ ID NO: 830897 - DNA, 20 bp, mouse
gaggggccaaggcggtagag

SEQ ID NO: 830898 - DNA, 20 bp, mouse
gagcctggtaggggccaagg

SEQ ID NO: 830899 - DNA, 20 bp, mouse
ggggcggccggccaggagct

SEQ ID NO: 830900 - DNA, 20 bp, mouse
gtaccgccttggcccctacc

SEQ ID NO: 830901 - DNA, 20 bp, mouse
ggactgcgaggcggcctgca

SEQ ID NO: 830902 - DNA, 20 bp, mouse
gcaaggcggtagaggggctg

SEQ ID NO: 830903 - DNA, 20 bp, mouse
gcaggccgcctcgcagtcgc

SEQ ID NO: 830904 - DNA, 20 bp, mouse
gccaggagctggggagcggc

SEQ ID NO: 830905 - DNA, 20 bp, mouse
ggcggggaccggcgactgcg

SEQ ID NO: 830906 - DNA, 20 bp, mouse
gtcacgcgcccgaagatcgg

SEQ ID NO: 830907 - DNA, 20 bp, mouse
gcgaagatcggcggtcacgt

SEQ ID NO: 830908 - DNA, 20 bp, mouse
gctcccgcctgggtggcctg

SEQ ID NO: 830909 - DNA, 20 bp, mouse
ggggacgcggggcgcgctag

SEQ ID NO: 830910 - DNA, 20 bp, mouse
ggcgtcacgcgcccgaagat

SEQ ID NO: 830911 - DNA, 20 bp, mouse
ggacgtaagcagaagacgag

SEQ ID NO: 830912 - DNA, 20 bp, mouse
gccccgctctccgacgacgg

SEQ ID NO: 830913 - DNA, 20 bp, mouse
ggaggcctctccaaaatggt

SEQ ID NO: 830914 - DNA, 20 bp, mouse
gcgtccccgctctccgacga

SEQ ID NO: 830915 - DNA, 20 bp, mouse
gaggcggtagccgccgtcgt

SEQ ID NO: 830916 - DNA, 20 bp, mouse
gacggggtccagtactgcgc

SEQ ID NO: 830917 - DNA, 20 bp, mouse
gtcgccgcccgcgcaggtcg

SEQ ID NO: 830918 - DNA, 20 bp, mouse
gacgctgcgcccctcagcgt

SEQ ID NO: 830919 - DNA, 20 bp, mouse
gtctctgccgcgacctgcgc

SEQ ID NO: 830920 - DNA, 20 bp, mouse
ggggcggcgaggtgcagggc

SEQ ID NO: 830921 - DNA, 20 bp, mouse
gccctcagcgtcggcgccgg

SEQ ID NO: 830922 - DNA, 20 bp, mouse
ggtcgcggcagagaggtcgc

SEQ ID NO: 830923 - DNA, 20 bp, mouse
ggcgctgggtcctccggagt

SEQ ID NO: 830924 - DNA, 20 bp, mouse
ggctgctgggagaatcgaac

SEQ ID NO: 830925 - DNA, 20 bp, mouse
gcaagggaatagggctcgct

SEQ ID NO: 830926 - DNA, 20 bp, mouse
gtggctgggcgagctgctga

SEQ ID NO: 830927 - DNA, 20 bp, mouse
gagcctggcaggtttgtccc

SEQ ID NO: 830928 - DNA, 20 bp, mouse
gagctcgcccagccagctag

SEQ ID NO: 830929 - DNA, 20 bp, mouse
gtcaggtgatccatctaccc

SEQ ID NO: 830930 - DNA, 20 bp, mouse
gctgggattggctcaaaaca

SEQ ID NO: 830931 - DNA, 20 bp, mouse
gggggaccaaacgctgggat

SEQ ID NO: 830932 - DNA, 20 bp, mouse
gggtccccagtgtctgtatc

SEQ ID NO: 830933 - DNA, 20 bp, mouse
gctgtgttgctccaatggtt

SEQ ID NO: 830934 - DNA, 20 bp, mouse
gacaaagagccccgaagcca

SEQ ID NO: 830935 - DNA, 20 bp, mouse
gcaagtgtactaggtgccaa

SEQ ID NO: 830936 - DNA, 20 bp, mouse
gcctagcttgccctgtggag

SEQ ID NO: 830937 - DNA, 20 bp, mouse
gccacagggcaagctagggg

SEQ ID NO: 830938 - DNA, 20 bp, mouse
gtggacccagagtttcctgc

SEQ ID NO: 830939 - DNA, 20 bp, mouse
gccccgaggcgggctctcag

SEQ ID NO: 830940 - DNA, 20 bp, mouse
gctgcccaggagtgggagcg

SEQ ID NO: 830941 - DNA, 20 bp, mouse
ggcgggctctcagagggcgg

SEQ ID NO: 830942 - DNA, 20 bp, mouse
ggcgaccacacctcctagca

SEQ ID NO: 830943 - DNA, 20 bp, mouse
gccgcctcggggcgtggtcc

SEQ ID NO: 830944 - DNA, 20 bp, mouse
ggcagcgggaagtggactgt

SEQ ID NO: 830945 - DNA, 20 bp, mouse
gaaaggaagatgcgctgccc

SEQ ID NO: 830946 - DNA, 20 bp, mouse
gcggccgccaaggggagagt

SEQ ID NO: 830947 - DNA, 20 bp, mouse
gtggggcagcagtccttcaa

SEQ ID NO: 830948 - DNA, 20 bp, mouse
gagagtctgaaggcagtcag

SEQ ID NO: 830949 - DNA, 20 bp, mouse
gctgccctctagcctctgtc

SEQ ID NO: 830950 - DNA, 20 bp, mouse
gaagggacatccaccaggag

SEQ ID NO: 830951 - DNA, 20 bp, mouse
gggcccacccaactacccca

SEQ ID NO: 830952 - DNA, 20 bp, mouse
gggtccctggggtagttggg

SEQ ID NO: 830953 - DNA, 20 bp, mouse
ggccccctggcggccgccaa

SEQ ID NO: 830954 - DNA, 20 bp, mouse
gtgtccggacagaggctaga

SEQ ID NO: 830955 - DNA, 20 bp, mouse
ggctgcccagggccgtcaat

SEQ ID NO: 830956 - DNA, 20 bp, mouse
ggacccgaggggaccaccgg

SEQ ID NO: 830957 - DNA, 20 bp, mouse
gagagccaaggggacccgag

SEQ ID NO: 830958 - DNA, 20 bp, mouse
gtgccggggagttctcgggg

SEQ ID NO: 830959 - DNA, 20 bp, mouse
gccccgccggtggtcccctc

SEQ ID NO: 830960 - DNA, 20 bp, mouse
gtgccctcgctgccccccgc

SEQ ID NO: 830961 - DNA, 20 bp, mouse
gcatgtgccggggagttctc

SEQ ID NO: 830962 - DNA, 20 bp, mouse
ggggcgggcgcgtggggtct

SEQ ID NO: 830963 - DNA, 20 bp, mouse
gggggggcagcgagggcaca

SEQ ID NO: 830964 - DNA, 20 bp, mouse
gcaccggcggggggcagcga

SEQ ID NO: 830965 - DNA, 20 bp, mouse
gcgccgccagctgtagggaa

SEQ ID NO: 830966 - DNA, 20 bp, mouse
ggaggggaaggcatgaggga

SEQ ID NO: 830967 - DNA, 20 bp, mouse
gtggctgcctggtgcgtccc

SEQ ID NO: 830968 - DNA, 20 bp, mouse
gtaacccagagaaggggagg

SEQ ID NO: 830969 - DNA, 20 bp, mouse
ggggtgcactaacccagaga

SEQ ID NO: 830970 - DNA, 20 bp, mouse
ggcaccggagcagctgctgt

SEQ ID NO: 830971 - DNA, 20 bp, mouse
gtgggaggctaggcgcaagg

SEQ ID NO: 830972 - DNA, 20 bp, mouse
gcggctcccggggacgcacc

SEQ ID NO: 830973 - DNA, 20 bp, mouse
gtgcaggtgctggctaagtg

SEQ ID NO: 830974 - DNA, 20 bp, mouse
gcaactggcctcaaccccct

SEQ ID NO: 830975 - DNA, 20 bp, mouse
ggcagccaatggatgcgcag

SEQ ID NO: 830976 - DNA, 20 bp, mouse
gtaggcctgagaggtctgtt

SEQ ID NO: 830977 - DNA, 20 bp, mouse
ggtaacctaacagacctctc

SEQ ID NO: 830978 - DNA, 20 bp, mouse
gtacgtgcgacccaacccgg

SEQ ID NO: 830979 - DNA, 20 bp, mouse
gtcactgtctacactgggag

SEQ ID NO: 830980 - DNA, 20 bp, mouse
ggcggtgccgatgacaagct

SEQ ID NO: 830981 - DNA, 20 bp, mouse
gagaccggtcccagcactag

SEQ ID NO: 830982 - DNA, 20 bp, mouse
gctcaggcctagcttgtcat

SEQ ID NO: 830983 - DNA, 20 bp, mouse
gccgccacaccggtctaata

SEQ ID NO: 830984 - DNA, 20 bp, mouse
ggcaccaggcccaggatgcc

SEQ ID NO: 830985 - DNA, 20 bp, mouse
gtatggctccccactaagtg

SEQ ID NO: 830986 - DNA, 20 bp, mouse
gcggcaccggagccaccgga

SEQ ID NO: 830987 - DNA, 20 bp, mouse
gcaccggagccaccggaagg

SEQ ID NO: 830988 - DNA, 20 bp, mouse
ggcggcgtgcaggaccgctt

SEQ ID NO: 830989 - DNA, 20 bp, mouse
gcctgcacgccgccttccgg

SEQ ID NO: 830990 - DNA, 20 bp, mouse
ggtgacaacagcttccaagt

SEQ ID NO: 830991 - DNA, 20 bp, mouse
gactcctgagaaacctaata

SEQ ID NO: 830992 - DNA, 20 bp, mouse
gtgggcggcaccggagccac

SEQ ID NO: 830993 - DNA, 20 bp, mouse
gggtcctgcacgccgccttc

SEQ ID NO: 830994 - DNA, 20 bp, mouse
gctagtcgctgtttaaagaa

SEQ ID NO: 830995 - DNA, 20 bp, mouse
gtgcgaggactgggcggcac

SEQ ID NO: 830996 - DNA, 20 bp, mouse
ggggccgaaccggtgaactc

SEQ ID NO: 830997 - DNA, 20 bp, mouse
gaggcatctctgattgtcaa

SEQ ID NO: 830998 - DNA, 20 bp, mouse
ggggacgccccatagagggc

SEQ ID NO: 830999 - DNA, 20 bp, mouse
gtgcaggcccgccctctatg

SEQ ID NO: 831000 - DNA, 20 bp, mouse
gccggtgcgcgttccactga

SEQ ID NO: 831001 - DNA, 20 bp, mouse
ggctcccgagctcacgtgac

SEQ ID NO: 831002 - DNA, 20 bp, mouse
gcaggcgcgaccccgagacc

SEQ ID NO: 831003 - DNA, 20 bp, mouse
gttccgggacgccccataga

SEQ ID NO: 831004 - DNA, 20 bp, mouse
ggacccggtcacgtgagctc

SEQ ID NO: 831005 - DNA, 20 bp, mouse
ggatcctgagttcaccggtt

SEQ ID NO: 831006 - DNA, 20 bp, mouse
gtgcccggagggaaccactg

SEQ ID NO: 831007 - DNA, 20 bp, mouse
gaggagagcgccctccgcag

SEQ ID NO: 831008 - DNA, 20 bp, mouse
gcggagggaaccactgcgga

SEQ ID NO: 831009 - DNA, 20 bp, mouse
gaggccggtcacctgcccgg

SEQ ID NO: 831010 - DNA, 20 bp, mouse
gcggagagctgtgcgcagtt

SEQ ID NO: 831011 - DNA, 20 bp, mouse
gccccagtgctcgacactga

SEQ ID NO: 831012 - DNA, 20 bp, mouse
ggtgttgtgcaagacgggaa

SEQ ID NO: 831013 - DNA, 20 bp, mouse
gtgctcccacgctccggggt

SEQ ID NO: 831014 - DNA, 20 bp, mouse
gaagaggaagaacggccggt

SEQ ID NO: 831015 - DNA, 20 bp, mouse
gagggcgctctcctagcgag

SEQ ID NO: 831016 - DNA, 20 bp, mouse
gcactctcagtcctgtgatt

SEQ ID NO: 831017 - DNA, 20 bp, mouse
gggcgagtcagcccaatcac

SEQ ID NO: 831018 - DNA, 20 bp, mouse
ggactcgcccagggaaaaga

SEQ ID NO: 831019 - DNA, 20 bp, mouse
gcccagggaaaagacggtta

SEQ ID NO: 831020 - DNA, 20 bp, mouse
gtctagattcagccaatcgg

SEQ ID NO: 831021 - DNA, 20 bp, mouse
ggactggaggtgttccattt

SEQ ID NO: 831022 - DNA, 20 bp, mouse
gtccctaaccgtcttttccc

SEQ ID NO: 831023 - DNA, 20 bp, mouse
gaagacggttagggaccctg

SEQ ID NO: 831024 - DNA, 20 bp, mouse
gtggcttgctgctactaaag

SEQ ID NO: 831025 - DNA, 20 bp, mouse
ggattgggctgactcgccca

SEQ ID NO: 831026 - DNA, 20 bp, mouse
gaactcccagagtatcaggg

SEQ ID NO: 831027 - DNA, 20 bp, mouse
ggtaaggctcatctaggcga

SEQ ID NO: 831028 - DNA, 20 bp, mouse
gcgcgcggcactcaagtccc

SEQ ID NO: 831029 - DNA, 20 bp, mouse
ggcgccgcccccacgatctc

SEQ ID NO: 831030 - DNA, 20 bp, mouse
gaccccaggcctcttagccc

SEQ ID NO: 831031 - DNA, 20 bp, mouse
ggatgaagtgagtccgtcaa

SEQ ID NO: 831032 - DNA, 20 bp, mouse
ggaacggctagttctggcct

SEQ ID NO: 831033 - DNA, 20 bp, mouse
ggcagaaggtgatgctccgg

SEQ ID NO: 831034 - DNA, 20 bp, mouse
gcggtggtgggtctgagcca

SEQ ID NO: 831035 - DNA, 20 bp, mouse
ggggagagtgggtcttcggt

SEQ ID NO: 831036 - DNA, 20 bp, mouse
gccgcgctgccaccaggcaa

SEQ ID NO: 831037 - DNA, 20 bp, mouse
ggacgcaatgccagtagttt

SEQ ID NO: 831038 - DNA, 20 bp, mouse
gctaaacccggctgccagga

SEQ ID NO: 831039 - DNA, 20 bp, mouse
ggatttctgtagtttcagag

SEQ ID NO: 831040 - DNA, 20 bp, mouse
gtcgccgccatcttggatcg

SEQ ID NO: 831041 - DNA, 20 bp, mouse
ggggtttaggcttcaaggac

SEQ ID NO: 831042 - DNA, 20 bp, mouse
gttcaaggacggggttcact

SEQ ID NO: 831043 - DNA, 20 bp, mouse
ggcgcagccgcgctgccacc

SEQ ID NO: 831044 - DNA, 20 bp, mouse
gaagcctaaacccggctgcc

SEQ ID NO: 831045 - DNA, 20 bp, mouse
gctgccggctcctaggcgtc

SEQ ID NO: 831046 - DNA, 20 bp, mouse
ggcccgccaggtcactgctc

SEQ ID NO: 831047 - DNA, 20 bp, mouse
ggacccggataggtcttgac

SEQ ID NO: 831048 - DNA, 20 bp, mouse
gtctccgggaattgcggtcc

SEQ ID NO: 831049 - DNA, 20 bp, mouse
gggccagtcaagacctatcc

SEQ ID NO: 831050 - DNA, 20 bp, mouse
gctccgtcgtgtccagtcgc

SEQ ID NO: 831051 - DNA, 20 bp, mouse
gaaagagtacaccctgcgac

SEQ ID NO: 831052 - DNA, 20 bp, mouse
ggggggaagcccttctccag

SEQ ID NO: 831053 - DNA, 20 bp, mouse
gacggagcacgttgtcgctg

SEQ ID NO: 831054 - DNA, 20 bp, mouse
gaccctgcgactggacacga

SEQ ID NO: 831055 - DNA, 20 bp, mouse
gaattgcggtcccgggaaag

SEQ ID NO: 831056 - DNA, 20 bp, mouse
gatgtggcggagcagggtgc

SEQ ID NO: 831057 - DNA, 20 bp, mouse
ggggagaaatctcaaggatg

SEQ ID NO: 831058 - DNA, 20 bp, mouse
gctaggcaaaggaacgccaa

SEQ ID NO: 831059 - DNA, 20 bp, mouse
gttgaagaaaggggcggaga

SEQ ID NO: 831060 - DNA, 20 bp, mouse
gcctgtgggagcaggtaagg

SEQ ID NO: 831061 - DNA, 20 bp, mouse
gccgctgccggcgagggagt

SEQ ID NO: 831062 - DNA, 20 bp, mouse
gcgagaatttaattgaagaa

SEQ ID NO: 831063 - DNA, 20 bp, mouse
gttacctgctcccacaggag

SEQ ID NO: 831064 - DNA, 20 bp, mouse
gcctatagggagaaatctca

SEQ ID NO: 831065 - DNA, 20 bp, mouse
gcatttgggtgtgttggaga

SEQ ID NO: 831066 - DNA, 20 bp, mouse
gggggctaatcccaagtgtg

SEQ ID NO: 831067 - DNA, 20 bp, mouse
gcatccccaggcaacatatc

SEQ ID NO: 831068 - DNA, 20 bp, mouse
gcacatcttgaaagtgaagg

SEQ ID NO: 831069 - DNA, 20 bp, mouse
gcaacggagcccacacactt

SEQ ID NO: 831070 - DNA, 20 bp, mouse
gatcttgaaagtgaaggcgg

SEQ ID NO: 831071 - DNA, 20 bp, mouse
gtgtcctgatatgttgcctg

SEQ ID NO: 831072 - DNA, 20 bp, mouse
gtgtggattttgaaggtccg

SEQ ID NO: 831073 - DNA, 20 bp, mouse
ggtgccttccatcagtggaa

SEQ ID NO: 831074 - DNA, 20 bp, mouse
ggaaagtgaaggcggtggag

SEQ ID NO: 831075 - DNA, 20 bp, mouse
gcatagcttaaaaacagaat

SEQ ID NO: 831076 - DNA, 20 bp, mouse
ggcgtgtcggggcgtgtcaa

SEQ ID NO: 831077 - DNA, 20 bp, mouse
gaggagaagggggtcccggc

SEQ ID NO: 831078 - DNA, 20 bp, mouse
gcagcaggagaagggggtcc

SEQ ID NO: 831079 - DNA, 20 bp, mouse
gcaaaccacgccacgcctcc

SEQ ID NO: 831080 - DNA, 20 bp, mouse
gtggggatgtaatgtgtcgg

SEQ ID NO: 831081 - DNA, 20 bp, mouse
gtgactctgaggggcgtgtc

SEQ ID NO: 831082 - DNA, 20 bp, mouse
ggggcgagcggagcgtagga

SEQ ID NO: 831083 - DNA, 20 bp, mouse
gggcgtgtcaagggagtgtc

SEQ ID NO: 831084 - DNA, 20 bp, mouse
gaggcgtggcgtggtttgcg

SEQ ID NO: 831085 - DNA, 20 bp, mouse
ggcgagccagccagtcgctg

SEQ ID NO: 831086 - DNA, 20 bp, mouse
gcccccccccagacccggaa

SEQ ID NO: 831087 - DNA, 20 bp, mouse
ggcgccacgtggaactaggc

SEQ ID NO: 831088 - DNA, 20 bp, mouse
gcctcccttccgggtctggg

SEQ ID NO: 831089 - DNA, 20 bp, mouse
gtaaagttctctgtgggcgg

SEQ ID NO: 831090 - DNA, 20 bp, mouse
gcagctagtgacatactctg

SEQ ID NO: 831091 - DNA, 20 bp, mouse
gtctgtgggtcaggcttcct

SEQ ID NO: 831092 - DNA, 20 bp, mouse
ggaagggaggagggagcgtt

SEQ ID NO: 831093 - DNA, 20 bp, mouse
gccttcctcccttccgggtc

SEQ ID NO: 831094 - DNA, 20 bp, mouse
gaccatgtggctaagtgcac

SEQ ID NO: 831095 - DNA, 20 bp, mouse
gctgacaagtgtgagtcatc

SEQ ID NO: 831096 - DNA, 20 bp, mouse
gggaggaggggaaacgccgt

SEQ ID NO: 831097 - DNA, 20 bp, mouse
gggaggaagcagatggccaa

SEQ ID NO: 831098 - DNA, 20 bp, mouse
gcacccaggcaaatgctggc

SEQ ID NO: 831099 - DNA, 20 bp, mouse
gatggccaagggcggaggag

SEQ ID NO: 831100 - DNA, 20 bp, mouse
gcgtgggggaactgccaccc

SEQ ID NO: 831101 - DNA, 20 bp, mouse
gtcaagtttggggatctgga

SEQ ID NO: 831102 - DNA, 20 bp, mouse
gaacaaagcagaaatttcag

SEQ ID NO: 831103 - DNA, 20 bp, mouse
ggggatgcactgtccccagg

SEQ ID NO: 831104 - DNA, 20 bp, mouse
ggtggggatgcactgtcccc

SEQ ID NO: 831105 - DNA, 20 bp, mouse
gaatttgagaggtattgtaa

SEQ ID NO: 831106 - DNA, 20 bp, mouse
gtaaagaggcggtacttcgg

SEQ ID NO: 831107 - DNA, 20 bp, mouse
gacctccgcttgattggtgg

SEQ ID NO: 831108 - DNA, 20 bp, mouse
ggggcggggcgctgagttcc

SEQ ID NO: 831109 - DNA, 20 bp, mouse
gggcgcggaagccttcgttt

SEQ ID NO: 831110 - DNA, 20 bp, mouse
gtggaagacctccgcttgat

SEQ ID NO: 831111 - DNA, 20 bp, mouse
gaagacctccgcttgattgg

SEQ ID NO: 831112 - DNA, 20 bp, mouse
gttccagttagggttaaaga

SEQ ID NO: 831113 - DNA, 20 bp, mouse
gaggagctggtacccaaact

SEQ ID NO: 831114 - DNA, 20 bp, mouse
gacttcgggggcgtggcggt

SEQ ID NO: 831115 - DNA, 20 bp, mouse
gacccaaactcggctcctat

SEQ ID NO: 831116 - DNA, 20 bp, mouse
gcacaagcccgggatgggtg

SEQ ID NO: 831117 - DNA, 20 bp, mouse
ggtccagcccccacaagccc

SEQ ID NO: 831118 - DNA, 20 bp, mouse
gtgtgacaaggacagatctg

SEQ ID NO: 831119 - DNA, 20 bp, mouse
ggcccccacaagcccgggat

SEQ ID NO: 831120 - DNA, 20 bp, mouse
ggaagggggggcattagagg

SEQ ID NO: 831121 - DNA, 20 bp, mouse
ggcagatggaagggaccgaa

SEQ ID NO: 831122 - DNA, 20 bp, mouse
gggcattagaggtgggaggc

SEQ ID NO: 831123 - DNA, 20 bp, mouse
gtggaggcaggacattgttc

SEQ ID NO: 831124 - DNA, 20 bp, mouse
gcctggaagtctctggaagg

SEQ ID NO: 831125 - DNA, 20 bp, mouse
gtcagtgcacctcggtgctg

SEQ ID NO: 831126 - DNA, 20 bp, mouse
gcaacccgaggcgtggggag

SEQ ID NO: 831127 - DNA, 20 bp, mouse
gcctcccaaggcccgagatc

SEQ ID NO: 831128 - DNA, 20 bp, mouse
ggactcaaacccggtcagtc

SEQ ID NO: 831129 - DNA, 20 bp, mouse
ggtgcccggcgactcaaacc

SEQ ID NO: 831130 - DNA, 20 bp, mouse
gcccacagcagctcttaatc

SEQ ID NO: 831131 - DNA, 20 bp, mouse
gggcatgtgacccgggagct

SEQ ID NO: 831132 - DNA, 20 bp, mouse
ggaaaagggctggacggcgg

SEQ ID NO: 831133 - DNA, 20 bp, mouse
gaggcagttggaggactcgt

SEQ ID NO: 831134 - DNA, 20 bp, mouse
gtctagatggcatgtgaccc

SEQ ID NO: 831135 - DNA, 20 bp, mouse
gtccagattaagagctgctg

SEQ ID NO: 831136 - DNA, 20 bp, mouse
ggacaccgagctggcagaag

SEQ ID NO: 831137 - DNA, 20 bp, mouse
gcatgcgtgacccctaccca

SEQ ID NO: 831138 - DNA, 20 bp, mouse
gaagacacccggtggggcca

SEQ ID NO: 831139 - DNA, 20 bp, mouse
gaagcccggtagtccttcac

SEQ ID NO: 831140 - DNA, 20 bp, mouse
gcgctagcatatcgactcag

SEQ ID NO: 831141 - DNA, 20 bp, mouse
ggaaaccagtgaaggactac

SEQ ID NO: 831142 - DNA, 20 bp, mouse
gggggtcacgcatgccatca

SEQ ID NO: 831143 - DNA, 20 bp, mouse
gggtgtccaaacggtttaaa

SEQ ID NO: 831144 - DNA, 20 bp, mouse
ggtcttctaagacacccggt

SEQ ID NO: 831145 - DNA, 20 bp, mouse
gggggcaaccaagtacggag

SEQ ID NO: 831146 - DNA, 20 bp, mouse
gtctaggaggggcctccgga

SEQ ID NO: 831147 - DNA, 20 bp, mouse
gggaagggacagtagtgcat

SEQ ID NO: 831148 - DNA, 20 bp, mouse
gggagcatgtgggtactcat

SEQ ID NO: 831149 - DNA, 20 bp, mouse
gggagagcatgaacactcat

SEQ ID NO: 831150 - DNA, 20 bp, mouse
gaggttccttccaactgtct

SEQ ID NO: 831151 - DNA, 20 bp, mouse
gaggctgaaataatagaggc

SEQ ID NO: 831152 - DNA, 20 bp, mouse
gtctgaggctgaaataatag

SEQ ID NO: 831153 - DNA, 20 bp, mouse
gacaggggaagggagcctgt

SEQ ID NO: 831154 - DNA, 20 bp, mouse
gagggagttcctgggttatg

SEQ ID NO: 831155 - DNA, 20 bp, mouse
gacgtaatggaggatctcta

SEQ ID NO: 831156 - DNA, 20 bp, mouse
gacacccagcgtgtggctca

SEQ ID NO: 831157 - DNA, 20 bp, mouse
ggacgggggcgcggcttctg

SEQ ID NO: 831158 - DNA, 20 bp, mouse
gcgggcgagcccgctgacgg

SEQ ID NO: 831159 - DNA, 20 bp, mouse
gggcgacgcagggtgattct

SEQ ID NO: 831160 - DNA, 20 bp, mouse
gaagccgcgcccccgtcagc

SEQ ID NO: 831161 - DNA, 20 bp, mouse
gccacacgctgggtgtccgg

SEQ ID NO: 831162 - DNA, 20 bp, mouse
gaccctgcgtcgccctctgc

SEQ ID NO: 831163 - DNA, 20 bp, mouse
ggaccagcagagggcgacgc

SEQ ID NO: 831164 - DNA, 20 bp, mouse
gaggaacgtgttgtcggcga

SEQ ID NO: 831165 - DNA, 20 bp, mouse
ggacgcagggtgattctagg

SEQ ID NO: 831166 - DNA, 20 bp, mouse
gaggaagctcctcctccgga

SEQ ID NO: 831167 - DNA, 20 bp, mouse
gcggctggtcgacaagtgat

SEQ ID NO: 831168 - DNA, 20 bp, mouse
gccctcacccgggtctctca

SEQ ID NO: 831169 - DNA, 20 bp, mouse
gttagggcggggctgcggag

SEQ ID NO: 831170 - DNA, 20 bp, mouse
gccgccagacccctccactc

SEQ ID NO: 831171 - DNA, 20 bp, mouse
gggggtcgaaatcacctggg

SEQ ID NO: 831172 - DNA, 20 bp, mouse
gtggcggtttgtcagccctc

SEQ ID NO: 831173 - DNA, 20 bp, mouse
gtgattggatgctgtggaag

SEQ ID NO: 831174 - DNA, 20 bp, mouse
ggatggggtcgaaatcacct

SEQ ID NO: 831175 - DNA, 20 bp, mouse
gtcccagttaggtaccacgt

SEQ ID NO: 831176 - DNA, 20 bp, mouse
gtaagttctagtttcttcaa

SEQ ID NO: 831177 - DNA, 20 bp, mouse
ggctcagagcgacaatgaaa

SEQ ID NO: 831178 - DNA, 20 bp, mouse
gcgggaagcaagcatccgtc

SEQ ID NO: 831179 - DNA, 20 bp, mouse
gataaaatgaatcgtcttaa

SEQ ID NO: 831180 - DNA, 20 bp, mouse
ggctccaaaaataccccagc

SEQ ID NO: 831181 - DNA, 20 bp, mouse
ggtactaaattctccacagc

SEQ ID NO: 831182 - DNA, 20 bp, mouse
gcttatctctgaacctgctg

SEQ ID NO: 831183 - DNA, 20 bp, mouse
gtattgcaaagcacaagcgg

SEQ ID NO: 831184 - DNA, 20 bp, mouse
gaaaataccccagcaggact

SEQ ID NO: 831185 - DNA, 20 bp, mouse
gttgaaaatgccaggggaaa

SEQ ID NO: 831186 - DNA, 20 bp, mouse
gatagggtgagccacaagaa

SEQ ID NO: 831187 - DNA, 20 bp, mouse
gcaagtacacaaagccacat

SEQ ID NO: 831188 - DNA, 20 bp, mouse
ggcagtgagccagtttcagt

SEQ ID NO: 831189 - DNA, 20 bp, mouse
gaaaccaagctggtgaaaag

SEQ ID NO: 831190 - DNA, 20 bp, mouse
ggtctcggaaaaactgactt

SEQ ID NO: 831191 - DNA, 20 bp, mouse
gtcaagggtaggtgacgcac

SEQ ID NO: 831192 - DNA, 20 bp, mouse
gttagagatacacgggtctt

SEQ ID NO: 831193 - DNA, 20 bp, mouse
gcatgtggttagagatacac

SEQ ID NO: 831194 - DNA, 20 bp, mouse
gttaaaaacaacagatcggc

SEQ ID NO: 831195 - DNA, 20 bp, mouse
ggaacttgaagcagcagggc

SEQ ID NO: 831196 - DNA, 20 bp, mouse
gagggtaagacatcaaaatt

SEQ ID NO: 831197 - DNA, 20 bp, mouse
gcggacagaggtagatgaac

SEQ ID NO: 831198 - DNA, 20 bp, mouse
gttgctggagatagcttaga

SEQ ID NO: 831199 - DNA, 20 bp, mouse
ggaaaaaaaaccaaccccca

SEQ ID NO: 831200 - DNA, 20 bp, mouse
ggagatgcagttagacttac

SEQ ID NO: 831201 - DNA, 20 bp, mouse
gaatggtttcgtccggacag

SEQ ID NO: 831202 - DNA, 20 bp, mouse
gtgagtctggaaacaaaagg

SEQ ID NO: 831203 - DNA, 20 bp, mouse
gaaaccattctcagtgagtc

SEQ ID NO: 831204 - DNA, 20 bp, mouse
gcactgagaatggtttcgtc

SEQ ID NO: 831205 - DNA, 20 bp, mouse
gctgcacccctgggctgggt

SEQ ID NO: 831206 - DNA, 20 bp, mouse
gaaggaacgggaagattgtg

SEQ ID NO: 831207 - DNA, 20 bp, mouse
gtgctgaggcacttttctca

SEQ ID NO: 831208 - DNA, 20 bp, mouse
gcatgtatatacagatgctc

SEQ ID NO: 831209 - DNA, 20 bp, mouse
ggaatgacctccctcaatct

SEQ ID NO: 831210 - DNA, 20 bp, mouse
gtcattcaggatgaaggaac

SEQ ID NO: 831211 - DNA, 20 bp, mouse
ggtaacgagcttcctctccc

SEQ ID NO: 831212 - DNA, 20 bp, mouse
ggagaggaagctcgttacga

SEQ ID NO: 831213 - DNA, 20 bp, mouse
gtggccaccacaagaaacac

SEQ ID NO: 831214 - DNA, 20 bp, mouse
gtgtgtgatcaaatatgctg

SEQ ID NO: 831215 - DNA, 20 bp, mouse
gggaagattgtgcggcagaa

SEQ ID NO: 831216 - DNA, 20 bp, mouse
gagaatcaagatcgaattaa

SEQ ID NO: 831217 - DNA, 20 bp, mouse
gtaaaaaaccaaaacgctat

SEQ ID NO: 831218 - DNA, 20 bp, mouse
gcttgactctagacgagaga

SEQ ID NO: 831219 - DNA, 20 bp, mouse
gaggactgttttatgtgagt

SEQ ID NO: 831220 - DNA, 20 bp, mouse
gacttccccttccagtccag

SEQ ID NO: 831221 - DNA, 20 bp, mouse
gttggaatagtccactggac

SEQ ID NO: 831222 - DNA, 20 bp, mouse
gaggtgaccctgaacgaaca

SEQ ID NO: 831223 - DNA, 20 bp, mouse
gagactttggaatagtccac

SEQ ID NO: 831224 - DNA, 20 bp, mouse
gtacgaacaaatacaagata

SEQ ID NO: 831225 - DNA, 20 bp, mouse
gaaacagcatcgtctcaaca

SEQ ID NO: 831226 - DNA, 20 bp, mouse
ggcgtctcccggacaaccgg

SEQ ID NO: 831227 - DNA, 20 bp, mouse
ggagggatggaatgctaaca

SEQ ID NO: 831228 - DNA, 20 bp, mouse
gtcccggacaaccggaggga

SEQ ID NO: 831229 - DNA, 20 bp, mouse
gcaggcgtctcccggacaac

SEQ ID NO: 831230 - DNA, 20 bp, mouse
gctctggcgtgggctctcca

SEQ ID NO: 831231 - DNA, 20 bp, mouse
gcaaacgctcaggcgtctcc

SEQ ID NO: 831232 - DNA, 20 bp, mouse
gtgagtgagtggcagagcgc

SEQ ID NO: 831233 - DNA, 20 bp, mouse
gggaatgctaacaaggctgc

SEQ ID NO: 831234 - DNA, 20 bp, mouse
gtggctccctgaacccacca

SEQ ID NO: 831235 - DNA, 20 bp, mouse
gccaggctgcgctgggaaac

SEQ ID NO: 831236 - DNA, 20 bp, mouse
gacgtcgcagagaaaaaggg

SEQ ID NO: 831237 - DNA, 20 bp, mouse
ggccacgtcgcagagaaaaa

SEQ ID NO: 831238 - DNA, 20 bp, mouse
gcggcccggcccaggtgaga

SEQ ID NO: 831239 - DNA, 20 bp, mouse
gcggaagtgacatgctctct

SEQ ID NO: 831240 - DNA, 20 bp, mouse
gcggaccgcgcggggacctc

SEQ ID NO: 831241 - DNA, 20 bp, mouse
ggggaagagcggcccggccc

SEQ ID NO: 831242 - DNA, 20 bp, mouse
ggaagtgacgtttgcagttg

SEQ ID NO: 831243 - DNA, 20 bp, mouse
gagcttgaaggcgtagctcc

SEQ ID NO: 831244 - DNA, 20 bp, mouse
gtagcagcaggtcagagatt

SEQ ID NO: 831245 - DNA, 20 bp, mouse
gggaacccgaggtccccgcg

SEQ ID NO: 831246 - DNA, 20 bp, mouse
gccgtgcactctgacctcgg

SEQ ID NO: 831247 - DNA, 20 bp, mouse
ggcgcgcacgggtttgtggg

SEQ ID NO: 831248 - DNA, 20 bp, mouse
gacggcgcgcacagccttgt

SEQ ID NO: 831249 - DNA, 20 bp, mouse
ggtccctaagcactgtcctt

SEQ ID NO: 831250 - DNA, 20 bp, mouse
gcagagtgcacggcgcgcac

SEQ ID NO: 831251 - DNA, 20 bp, mouse
gacgacgcgcgctgccttgt

SEQ ID NO: 831252 - DNA, 20 bp, mouse
gggggcaccacgggaaacag

SEQ ID NO: 831253 - DNA, 20 bp, mouse
ggcgccgtgcactctgacct

SEQ ID NO: 831254 - DNA, 20 bp, mouse
gcagcagtctgacaaagctg

SEQ ID NO: 831255 - DNA, 20 bp, mouse
gccagggcgtcaaaagtcag

SEQ ID NO: 831256 - DNA, 20 bp, mouse
gccagggcgtggaggttcgg

SEQ ID NO: 831257 - DNA, 20 bp, mouse
gcgtggaggctccccggcca

SEQ ID NO: 831258 - DNA, 20 bp, mouse
gctccccggccagggcgtgg

SEQ ID NO: 831259 - DNA, 20 bp, mouse
gaacctccacgccctggccg

SEQ ID NO: 831260 - DNA, 20 bp, mouse
gggaggcgtgctactggacg

SEQ ID NO: 831261 - DNA, 20 bp, mouse
gccggagcgtggaggctccc

SEQ ID NO: 831262 - DNA, 20 bp, mouse
gtccacgctccgggtctaca

SEQ ID NO: 831263 - DNA, 20 bp, mouse
gcggaagtgatcccaggcgg

SEQ ID NO: 831264 - DNA, 20 bp, mouse
gcgtgctactggacggggat

SEQ ID NO: 831265 - DNA, 20 bp, mouse
gtgccgcagccaatggcaat

SEQ ID NO: 831266 - DNA, 20 bp, mouse
ggaaccaaggcgctaggatg

SEQ ID NO: 831267 - DNA, 20 bp, mouse
gcgaccagttaattgcacct

SEQ ID NO: 831268 - DNA, 20 bp, mouse
gctccccaggtgcaattaac

SEQ ID NO: 831269 - DNA, 20 bp, mouse
gggaacggatgtggcccttc

SEQ ID NO: 831270 - DNA, 20 bp, mouse
gcactgtgccaatgagggag

SEQ ID NO: 831271 - DNA, 20 bp, mouse
ggccaacggcgcgctcttat

SEQ ID NO: 831272 - DNA, 20 bp, mouse
gcgcttacatggaacggatg

SEQ ID NO: 831273 - DNA, 20 bp, mouse
ggtcgcatccgacgcttaca

SEQ ID NO: 831274 - DNA, 20 bp, mouse
gggcgctgtacgtagaccaa

SEQ ID NO: 831275 - DNA, 20 bp, mouse
gaggctcctcgactctcccc

SEQ ID NO: 831276 - DNA, 20 bp, mouse
gatcggcgcagaagcgtctt

SEQ ID NO: 831277 - DNA, 20 bp, mouse
gacagcgcacgcgcagcgat

SEQ ID NO: 831278 - DNA, 20 bp, mouse
ggctgtgtccaggatgaaga

SEQ ID NO: 831279 - DNA, 20 bp, mouse
gtcccacaatgccacgcaac

SEQ ID NO: 831280 - DNA, 20 bp, mouse
gtgggtgcttccctgttgcg

SEQ ID NO: 831281 - DNA, 20 bp, mouse
gtccctgttgcgtggcattg

SEQ ID NO: 831282 - DNA, 20 bp, mouse
gctgcgcgtgcgctgtgtcc

SEQ ID NO: 831283 - DNA, 20 bp, mouse
gtgtatccctggttctataa

SEQ ID NO: 831284 - DNA, 20 bp, mouse
ggcgtcttagggaaatagag

SEQ ID NO: 831285 - DNA, 20 bp, mouse
gtcctgcataactacagaga

SEQ ID NO: 831286 - DNA, 20 bp, mouse
gtccctcgacgctgatgcat

SEQ ID NO: 831287 - DNA, 20 bp, mouse
gtcaactaggggccccattg

SEQ ID NO: 831288 - DNA, 20 bp, mouse
gccagccagagtgacgacaa

SEQ ID NO: 831289 - DNA, 20 bp, mouse
gctaggtaagcgtgtggaat

SEQ ID NO: 831290 - DNA, 20 bp, mouse
gaagccgctgaagagcggtc

SEQ ID NO: 831291 - DNA, 20 bp, mouse
gtgcctatgcatcagcgtcg

SEQ ID NO: 831292 - DNA, 20 bp, mouse
gaagcgtgtggaatcggctg

SEQ ID NO: 831293 - DNA, 20 bp, mouse
ggcttctcaagagttttcaa

SEQ ID NO: 831294 - DNA, 20 bp, mouse
gtcccggcacgcaccgcaat

SEQ ID NO: 831295 - DNA, 20 bp, mouse
gttgagaagccgctgaagag

SEQ ID NO: 831296 - DNA, 20 bp, mouse
gagtggaagcggcgcgtccc

SEQ ID NO: 831297 - DNA, 20 bp, mouse
ggcaagcggctgcgcagcga

SEQ ID NO: 831298 - DNA, 20 bp, mouse
gaggcgggccgctgcggaga

SEQ ID NO: 831299 - DNA, 20 bp, mouse
gtccgcagcggcccgcctgg

SEQ ID NO: 831300 - DNA, 20 bp, mouse
gatctcgagccgagtggaag

SEQ ID NO: 831301 - DNA, 20 bp, mouse
gcagcgagggtctcgctcga

SEQ ID NO: 831302 - DNA, 20 bp, mouse
gggccgctgcggagagggaa

SEQ ID NO: 831303 - DNA, 20 bp, mouse
ggcggagagggaatggtgcg

SEQ ID NO: 831304 - DNA, 20 bp, mouse
gtgggctccctgctgccgag

SEQ ID NO: 831305 - DNA, 20 bp, mouse
gccggggcccgcactcatgc

SEQ ID NO: 831306 - DNA, 20 bp, mouse
ggggaactacaaaaggacag

SEQ ID NO: 831307 - DNA, 20 bp, mouse
gtctgcgatccagcctggga

SEQ ID NO: 831308 - DNA, 20 bp, mouse
gactctgccccctcccaggc

SEQ ID NO: 831309 - DNA, 20 bp, mouse
gggctcccagaagaccaatc

SEQ ID NO: 831310 - DNA, 20 bp, mouse
gctccctgagcctcaacaag

SEQ ID NO: 831311 - DNA, 20 bp, mouse
gcgctcatcgatcgcgtcat

SEQ ID NO: 831312 - DNA, 20 bp, mouse
ggaggagaaagaaacccgat

SEQ ID NO: 831313 - DNA, 20 bp, mouse
gacaggtaagcctcttgttg

SEQ ID NO: 831314 - DNA, 20 bp, mouse
gcctccccccgggttttccc

SEQ ID NO: 831315 - DNA, 20 bp, mouse
ggaaacccgattggtcttct

SEQ ID NO: 831316 - DNA, 20 bp, mouse
gtctaacgatgggaggtgaa

SEQ ID NO: 831317 - DNA, 20 bp, mouse
ggagagggacaaaaagaact

SEQ ID NO: 831318 - DNA, 20 bp, mouse
gccgactaggagcgcaccaa

SEQ ID NO: 831319 - DNA, 20 bp, mouse
ggccagaggaaagaccgact

SEQ ID NO: 831320 - DNA, 20 bp, mouse
gacgaccaatgggatcgctg

SEQ ID NO: 831321 - DNA, 20 bp, mouse
gatcgctgaggtagtgcgtg

SEQ ID NO: 831322 - DNA, 20 bp, mouse
gtcctagtcggtctttcctc

SEQ ID NO: 831323 - DNA, 20 bp, mouse
ggaactgggcggagtacctt

SEQ ID NO: 831324 - DNA, 20 bp, mouse
gtggatggtggcggtcctta

SEQ ID NO: 831325 - DNA, 20 bp, mouse
gcggtccttagggccccagg

SEQ ID NO: 831326 - DNA, 20 bp, mouse
gtggcttgggggtaaagcca

SEQ ID NO: 831327 - DNA, 20 bp, mouse
gcgcgggccaatttggaagt

SEQ ID NO: 831328 - DNA, 20 bp, mouse
gcaaagaaacactggggcca

SEQ ID NO: 831329 - DNA, 20 bp, mouse
ggctccccgcagcaacaccg

SEQ ID NO: 831330 - DNA, 20 bp, mouse
gccgacgcggtgagctcaca

SEQ ID NO: 831331 - DNA, 20 bp, mouse
ggcggagcgcagcggctcga

SEQ ID NO: 831332 - DNA, 20 bp, mouse
gttaccgcggtgttgctgcg

SEQ ID NO: 831333 - DNA, 20 bp, mouse
gcagtccccgcgagcggaat

SEQ ID NO: 831334 - DNA, 20 bp, mouse
gtaattcgccagaagagttc

SEQ ID NO: 831335 - DNA, 20 bp, mouse
ggcccttcagtggaccacgt

SEQ ID NO: 831336 - DNA, 20 bp, mouse
gtagggatgatgactgtcga

SEQ ID NO: 831337 - DNA, 20 bp, mouse
ggctgatggcagtcaaactc

SEQ ID NO: 831338 - DNA, 20 bp, mouse
gaacgatttggaaagcctta

SEQ ID NO: 831339 - DNA, 20 bp, mouse
gagcttgttcatgaacgatt

SEQ ID NO: 831340 - DNA, 20 bp, mouse
gagcagcctgcagactaaaa

SEQ ID NO: 831341 - DNA, 20 bp, mouse
gagcactgttagactccgta

SEQ ID NO: 831342 - DNA, 20 bp, mouse
gaatgtaagccgatgggttt

SEQ ID NO: 831343 - DNA, 20 bp, mouse
gggctgcctcaggcccacct

SEQ ID NO: 831344 - DNA, 20 bp, mouse
gtggttcatcctaaacccat

SEQ ID NO: 831345 - DNA, 20 bp, mouse
gtgaagaagacaatggacca

SEQ ID NO: 831346 - DNA, 20 bp, mouse
gcccgcgtaaaagaacggtg

SEQ ID NO: 831347 - DNA, 20 bp, mouse
ggcagtggccaaggagctcg

SEQ ID NO: 831348 - DNA, 20 bp, mouse
gagctcgcccgctgggtggt

SEQ ID NO: 831349 - DNA, 20 bp, mouse
gaccgccatgtcgctttcga

SEQ ID NO: 831350 - DNA, 20 bp, mouse
gaagcggaaagtacgagctg

SEQ ID NO: 831351 - DNA, 20 bp, mouse
ggccctcgaaagcgacatgg

SEQ ID NO: 831352 - DNA, 20 bp, mouse
gcgcataggtggtgcctcga

SEQ ID NO: 831353 - DNA, 20 bp, mouse
ggtgggacgtcttgagagga

SEQ ID NO: 831354 - DNA, 20 bp, mouse
gtgagccctcgaaagcgaca

SEQ ID NO: 831355 - DNA, 20 bp, mouse
ggcgttctctgcagtggcca

SEQ ID NO: 831356 - DNA, 20 bp, mouse
ggaaagctgagaacacgtgg

SEQ ID NO: 831357 - DNA, 20 bp, mouse
gttaccacgtgggaaaatgt

SEQ ID NO: 831358 - DNA, 20 bp, mouse
gggtaacgaatctgcgtcta

SEQ ID NO: 831359 - DNA, 20 bp, mouse
gcatgcgtgctgacgctcaa

SEQ ID NO: 831360 - DNA, 20 bp, mouse
ggattccgttgccgtggaaa

SEQ ID NO: 831361 - DNA, 20 bp, mouse
gtcgacagattccgttgccg

SEQ ID NO: 831362 - DNA, 20 bp, mouse
ggagaattcgccattcctct

SEQ ID NO: 831363 - DNA, 20 bp, mouse
ggaccggaacgggagtgctc

SEQ ID NO: 831364 - DNA, 20 bp, mouse
gcaccagagcactcccgttc

SEQ ID NO: 831365 - DNA, 20 bp, mouse
gacgcagattcgttaccacg

SEQ ID NO: 831366 - DNA, 20 bp, mouse
gtcgcgcaaaggcggggtga

SEQ ID NO: 831367 - DNA, 20 bp, mouse
gggccgccaactcacttccg

SEQ ID NO: 831368 - DNA, 20 bp, mouse
gttagggatcagtcgagccc

SEQ ID NO: 831369 - DNA, 20 bp, mouse
gcccgcccctagtcgcgcaa

SEQ ID NO: 831370 - DNA, 20 bp, mouse
gtcgagccccggaagtgagt

SEQ ID NO: 831371 - DNA, 20 bp, mouse
gctcaggggcttaagtgaga

SEQ ID NO: 831372 - DNA, 20 bp, mouse
gagccccggaagtgagttgg

SEQ ID NO: 831373 - DNA, 20 bp, mouse
gtccccagccggctcacttc

SEQ ID NO: 831374 - DNA, 20 bp, mouse
gcggctggggaccggatgtg

SEQ ID NO: 831375 - DNA, 20 bp, mouse
ggcccctagtcgcgcaaagg

SEQ ID NO: 831376 - DNA, 20 bp, mouse
gtgggctggctggcagagga

SEQ ID NO: 831377 - DNA, 20 bp, mouse
gtgggggaagggggcgcagt

SEQ ID NO: 831378 - DNA, 20 bp, mouse
ggagtctggcagaactggga

SEQ ID NO: 831379 - DNA, 20 bp, mouse
gggaagggggcgcagtgggc

SEQ ID NO: 831380 - DNA, 20 bp, mouse
gtccatgcgaagggcggagt

SEQ ID NO: 831381 - DNA, 20 bp, mouse
gactgtgcatgacgtggagc

SEQ ID NO: 831382 - DNA, 20 bp, mouse
gggagtcaaagcctaggggc

SEQ ID NO: 831383 - DNA, 20 bp, mouse
gcagaggagggagtatcttt

SEQ ID NO: 831384 - DNA, 20 bp, mouse
gccttcctggcggccttgaa

SEQ ID NO: 831385 - DNA, 20 bp, mouse
gtatcctggggcccgcccct

SEQ ID NO: 831386 - DNA, 20 bp, mouse
gaacaaaagccggggttctg

SEQ ID NO: 831387 - DNA, 20 bp, mouse
gaggaggagcagaggatcct

SEQ ID NO: 831388 - DNA, 20 bp, mouse
ggccgccagccaccgagagg

SEQ ID NO: 831389 - DNA, 20 bp, mouse
gagaggctggggtgtagtta

SEQ ID NO: 831390 - DNA, 20 bp, mouse
ggggagcgcccggcctgcac

SEQ ID NO: 831391 - DNA, 20 bp, mouse
gccagctgtgcgactcgtta

SEQ ID NO: 831392 - DNA, 20 bp, mouse
gtggcactcacacacgaaaa

SEQ ID NO: 831393 - DNA, 20 bp, mouse
gctgatgggcccccgactct

SEQ ID NO: 831394 - DNA, 20 bp, mouse
gggccggcggtcatggggat

SEQ ID NO: 831395 - DNA, 20 bp, mouse
ggttgtgcccagcctggcac

SEQ ID NO: 831396 - DNA, 20 bp, mouse
ggccccgccccctttttgga

SEQ ID NO: 831397 - DNA, 20 bp, mouse
gggggcgcggggcgacaggg

SEQ ID NO: 831398 - DNA, 20 bp, mouse
gcagttgtgggcacgcgagt

SEQ ID NO: 831399 - DNA, 20 bp, mouse
gcggcgctgccattggtcgg

SEQ ID NO: 831400 - DNA, 20 bp, mouse
gcggaccccgagctcccgag

SEQ ID NO: 831401 - DNA, 20 bp, mouse
gtgtgggcacgcgagtgggt

SEQ ID NO: 831402 - DNA, 20 bp, mouse
gcggggggcgcggggcgaca

SEQ ID NO: 831403 - DNA, 20 bp, mouse
gcggccctccaaaaaggggg

SEQ ID NO: 831404 - DNA, 20 bp, mouse
gcctcatcggccctccaaaa

SEQ ID NO: 831405 - DNA, 20 bp, mouse
gcagcgccgcattacctcat

SEQ ID NO: 831406 - DNA, 20 bp, mouse
ggaaaagagcctggaagtag

SEQ ID NO: 831407 - DNA, 20 bp, mouse
gcctctgcaacttcccaact

SEQ ID NO: 831408 - DNA, 20 bp, mouse
gacttcccaactgggtttgt

SEQ ID NO: 831409 - DNA, 20 bp, mouse
ggtggcctggtgccaaagga

SEQ ID NO: 831410 - DNA, 20 bp, mouse
gccagaccaacaaacccagt

SEQ ID NO: 831411 - DNA, 20 bp, mouse
ggagccaatcacgcccccat

SEQ ID NO: 831412 - DNA, 20 bp, mouse
ggagcccatgggggcgtgat

SEQ ID NO: 831413 - DNA, 20 bp, mouse
ggaggaagattctgcagtta

SEQ ID NO: 831414 - DNA, 20 bp, mouse
gaggagggccttgggtcctg

SEQ ID NO: 831415 - DNA, 20 bp, mouse
gaacaggacagagaaagttg

SEQ ID NO: 831416 - DNA, 20 bp, mouse
gccaggctgaggtatcgtga

SEQ ID NO: 831417 - DNA, 20 bp, mouse
gagaaaacaacccctggtat

SEQ ID NO: 831418 - DNA, 20 bp, mouse
gagaatgagtctcaaggtcc

SEQ ID NO: 831419 - DNA, 20 bp, mouse
gtcccagcaggtgacattgg

SEQ ID NO: 831420 - DNA, 20 bp, mouse
gtcaggacattcctatacca

SEQ ID NO: 831421 - DNA, 20 bp, mouse
gcagtaaagaatgagtctca

SEQ ID NO: 831422 - DNA, 20 bp, mouse
gtcagaggaactgctgtcca

SEQ ID NO: 831423 - DNA, 20 bp, mouse
gataggaatgtcctgaaaca

SEQ ID NO: 831424 - DNA, 20 bp, mouse
gggctataaaagcactagca

SEQ ID NO: 831425 - DNA, 20 bp, mouse
gccatgggacaggtcccagc

SEQ ID NO: 831426 - DNA, 20 bp, mouse
ggacaagagatccctcaagg

SEQ ID NO: 831427 - DNA, 20 bp, mouse
gccaaccccggactgtggga

SEQ ID NO: 831428 - DNA, 20 bp, mouse
ggcaaggtgcccatcactgg

SEQ ID NO: 831429 - DNA, 20 bp, mouse
gttgagggatctcttgtcaa

SEQ ID NO: 831430 - DNA, 20 bp, mouse
gcctcccctcccacagtccg

SEQ ID NO: 831431 - DNA, 20 bp, mouse
gcgccccaaccccggactgt

SEQ ID NO: 831432 - DNA, 20 bp, mouse
ggagggcggggcccacttgt

SEQ ID NO: 831433 - DNA, 20 bp, mouse
gccgcacccacctcctgggg

SEQ ID NO: 831434 - DNA, 20 bp, mouse
gggagggcagaccccacaag

SEQ ID NO: 831435 - DNA, 20 bp, mouse
gggccaagaaggatgccctt

SEQ ID NO: 831436 - DNA, 20 bp, mouse
gttacagcttgcaggggtga

SEQ ID NO: 831437 - DNA, 20 bp, mouse
gccctccgcggcctcttccg

SEQ ID NO: 831438 - DNA, 20 bp, mouse
gcctaggtttacagcttgca

SEQ ID NO: 831439 - DNA, 20 bp, mouse
gcctctcgcgaaacagaaga

SEQ ID NO: 831440 - DNA, 20 bp, mouse
ggacgctgattcagacacct

SEQ ID NO: 831441 - DNA, 20 bp, mouse
gagcggctggcggcccggga

SEQ ID NO: 831442 - DNA, 20 bp, mouse
gccgcggcctcttccgggga

SEQ ID NO: 831443 - DNA, 20 bp, mouse
gccgccactgagggaaacgc

SEQ ID NO: 831444 - DNA, 20 bp, mouse
gggcaccggcgagtcaggac

SEQ ID NO: 831445 - DNA, 20 bp, mouse
ggagggcggagttaccactc

SEQ ID NO: 831446 - DNA, 20 bp, mouse
gcccgtgcgcgtgctccgga

SEQ ID NO: 831447 - DNA, 20 bp, mouse
gaggagcttcggggccgaga

SEQ ID NO: 831448 - DNA, 20 bp, mouse
ggagcggccgagggtccccg

SEQ ID NO: 831449 - DNA, 20 bp, mouse
gcgggcacgcgatgtgagag

SEQ ID NO: 831450 - DNA, 20 bp, mouse
gcgccgcgcgcccctccgtc

SEQ ID NO: 831451 - DNA, 20 bp, mouse
gaccctcggccgctcgcgag

SEQ ID NO: 831452 - DNA, 20 bp, mouse
ggccggctcgtcttcgggga

SEQ ID NO: 831453 - DNA, 20 bp, mouse
gtgcgcgtgctccggacgga

SEQ ID NO: 831454 - DNA, 20 bp, mouse
gtctcctcgcaggctcacgg

SEQ ID NO: 831455 - DNA, 20 bp, mouse
gccgggcgatcagtgagtgc

SEQ ID NO: 831456 - DNA, 20 bp, mouse
gctacccatccggaatgtct

SEQ ID NO: 831457 - DNA, 20 bp, mouse
gggaagcccgcctacccatc

SEQ ID NO: 831458 - DNA, 20 bp, mouse
ggtaggcgaagaggcgtggg

SEQ ID NO: 831459 - DNA, 20 bp, mouse
gccgtcccagacattccgga

SEQ ID NO: 831460 - DNA, 20 bp, mouse
gtgggacggcaatgagttct

SEQ ID NO: 831461 - DNA, 20 bp, mouse
gagggtaggcgaagaggcgt

SEQ ID NO: 831462 - DNA, 20 bp, mouse
gacattccggatgggtaggc

SEQ ID NO: 831463 - DNA, 20 bp, mouse
ggggtttagaacacgaacga

SEQ ID NO: 831464 - DNA, 20 bp, mouse
ggcgccaagggtaggcgaag

SEQ ID NO: 831465 - DNA, 20 bp, mouse
gaaacccggagacctatttc

SEQ ID NO: 831466 - DNA, 20 bp, mouse
gcgcgccgccctgaagtctc

SEQ ID NO: 831467 - DNA, 20 bp, mouse
ggaggggcgggacttgagcg

SEQ ID NO: 831468 - DNA, 20 bp, mouse
gcttacgtggagacgctgag

SEQ ID NO: 831469 - DNA, 20 bp, mouse
gtcacccggagacttcaggg

SEQ ID NO: 831470 - DNA, 20 bp, mouse
gacgtggagacgctgagggg

SEQ ID NO: 831471 - DNA, 20 bp, mouse
gacgtcacccggagacttca

SEQ ID NO: 831472 - DNA, 20 bp, mouse
ggcagtgaagcacggggctc

SEQ ID NO: 831473 - DNA, 20 bp, mouse
gactctggggtgacgtcacc

SEQ ID NO: 831474 - DNA, 20 bp, mouse
gtggtcccggaagtaaaacc

SEQ ID NO: 831475 - DNA, 20 bp, mouse
ggggtgacacacgtcttacg

SEQ ID NO: 831476 - DNA, 20 bp, mouse
ggccgtgaagccctgagccg

SEQ ID NO: 831477 - DNA, 20 bp, mouse
gcccgccggccggaccctag

SEQ ID NO: 831478 - DNA, 20 bp, mouse
ggactggcgagcgcccccta

SEQ ID NO: 831479 - DNA, 20 bp, mouse
gccccctagggtccggccgg

SEQ ID NO: 831480 - DNA, 20 bp, mouse
ggggtccggccggcgggtgt

SEQ ID NO: 831481 - DNA, 20 bp, mouse
gtcagcctcgggtcgtaacc

SEQ ID NO: 831482 - DNA, 20 bp, mouse
gacggcagcctcagggagct

SEQ ID NO: 831483 - DNA, 20 bp, mouse
gtaaaagaacggacctccca

SEQ ID NO: 831484 - DNA, 20 bp, mouse
ggcgagcgccccctagggtc

SEQ ID NO: 831485 - DNA, 20 bp, mouse
gccgcggtttgtcttgtgtg

SEQ ID NO: 831486 - DNA, 20 bp, mouse
ggagagtcggggtacgtgga

SEQ ID NO: 831487 - DNA, 20 bp, mouse
gcccacccatcaggcctcat

SEQ ID NO: 831488 - DNA, 20 bp, mouse
ggggagtggcaatgagagtc

SEQ ID NO: 831489 - DNA, 20 bp, mouse
gggaagaaggaagtcggtgt

SEQ ID NO: 831490 - DNA, 20 bp, mouse
gaccgggcgccgtgcgtcat

SEQ ID NO: 831491 - DNA, 20 bp, mouse
gtcccttaccaggtctgcaa

SEQ ID NO: 831492 - DNA, 20 bp, mouse
gaggactcaacagtgagaaa

SEQ ID NO: 831493 - DNA, 20 bp, mouse
gccagccaatgaggcctgat

SEQ ID NO: 831494 - DNA, 20 bp, mouse
ggcgccgtgcgtcatcggag

SEQ ID NO: 831495 - DNA, 20 bp, mouse
gggcctcggggtaaagcgtt

SEQ ID NO: 831496 - DNA, 20 bp, mouse
gcctgcgtggggcccatctg

SEQ ID NO: 831497 - DNA, 20 bp, mouse
gccgtcgcgggcaactcagg

SEQ ID NO: 831498 - DNA, 20 bp, mouse
gctagcgaggcgggagaagg

SEQ ID NO: 831499 - DNA, 20 bp, mouse
gtacgtgcgggagcaggctt

SEQ ID NO: 831500 - DNA, 20 bp, mouse
gaggatggatcgcgcggcag

SEQ ID NO: 831501 - DNA, 20 bp, mouse
gctcccgcacgtaacttccc

SEQ ID NO: 831502 - DNA, 20 bp, mouse
gaaagtagacaagtctgtgt

SEQ ID NO: 831503 - DNA, 20 bp, mouse
gggggtgaatcgaattctgc

SEQ ID NO: 831504 - DNA, 20 bp, mouse
gaggcccgggtactgcggag

SEQ ID NO: 831505 - DNA, 20 bp, mouse
gccgacggcacgtctctcgg

SEQ ID NO: 831506 - DNA, 20 bp, mouse
gtatgtatacggtaggggag

SEQ ID NO: 831507 - DNA, 20 bp, mouse
gtacggtaggggagtggaac

SEQ ID NO: 831508 - DNA, 20 bp, mouse
ggaaagactgaaagcagatc

SEQ ID NO: 831509 - DNA, 20 bp, mouse
gccttcccgtggtttctgag

SEQ ID NO: 831510 - DNA, 20 bp, mouse
ggccacccagcggtggggca

SEQ ID NO: 831511 - DNA, 20 bp, mouse
gcgcaggtgctggcgaggaa

SEQ ID NO: 831512 - DNA, 20 bp, mouse
gtcactgtatgtatacggta

SEQ ID NO: 831513 - DNA, 20 bp, mouse
gcctcaccggcgccacccag

SEQ ID NO: 831514 - DNA, 20 bp, mouse
gctagagtgtgtgtggttag

SEQ ID NO: 831515 - DNA, 20 bp, mouse
gcggaaataccggttcctct

SEQ ID NO: 831516 - DNA, 20 bp, mouse
gaacccctgagtacccagag

SEQ ID NO: 831517 - DNA, 20 bp, mouse
ggtagatgctgtggggtgca

SEQ ID NO: 831518 - DNA, 20 bp, mouse
gagcatcctacgggatgaat

SEQ ID NO: 831519 - DNA, 20 bp, mouse
gggaaccggcaggactgtgc

SEQ ID NO: 831520 - DNA, 20 bp, mouse
gggcctctctgggtactcag

SEQ ID NO: 831521 - DNA, 20 bp, mouse
gcagcccagctcattactat

SEQ ID NO: 831522 - DNA, 20 bp, mouse
ggggctagctaggcctctct

SEQ ID NO: 831523 - DNA, 20 bp, mouse
gcacagcccattcatcccgt

SEQ ID NO: 831524 - DNA, 20 bp, mouse
gctctgtggtgtagatgctg

SEQ ID NO: 831525 - DNA, 20 bp, mouse
gaagctggaagcttgacagc

SEQ ID NO: 831526 - DNA, 20 bp, mouse
ggccatggccagatccggag

SEQ ID NO: 831527 - DNA, 20 bp, mouse
gccctggaggaacttgtctt

SEQ ID NO: 831528 - DNA, 20 bp, mouse
ggaaagggaaggaaacgcca

SEQ ID NO: 831529 - DNA, 20 bp, mouse
gtctggcccgcagaaaggga

SEQ ID NO: 831530 - DNA, 20 bp, mouse
ggaaacgccatggccagatc

SEQ ID NO: 831531 - DNA, 20 bp, mouse
gtggtgcagccgcccagagc

SEQ ID NO: 831532 - DNA, 20 bp, mouse
gtggaggaacttgtcttcgg

SEQ ID NO: 831533 - DNA, 20 bp, mouse
gtgcgggccagaatccctgg

SEQ ID NO: 831534 - DNA, 20 bp, mouse
gtgcccgcgaactcaaaagg

SEQ ID NO: 831535 - DNA, 20 bp, mouse
gcgctcaacgcttggaaatt

SEQ ID NO: 831536 - DNA, 20 bp, mouse
gaggcggtgcgaggtgtgga

SEQ ID NO: 831537 - DNA, 20 bp, mouse
gaaggggcggggccggacaa

SEQ ID NO: 831538 - DNA, 20 bp, mouse
gcggggccggacaaggggtg

SEQ ID NO: 831539 - DNA, 20 bp, mouse
gccattctgcggtctgtaag

SEQ ID NO: 831540 - DNA, 20 bp, mouse
gttgggtcagggccattctg

SEQ ID NO: 831541 - DNA, 20 bp, mouse
gtagcggatcccttaagggg

SEQ ID NO: 831542 - DNA, 20 bp, mouse
gcccaagtagatttagagaa

SEQ ID NO: 831543 - DNA, 20 bp, mouse
gggatggcataataatgccg

SEQ ID NO: 831544 - DNA, 20 bp, mouse
gacaggacatcctgagtagg

SEQ ID NO: 831545 - DNA, 20 bp, mouse
gaggacttgcacatcagcca

SEQ ID NO: 831546 - DNA, 20 bp, mouse
gtcccagcacagtgccctgt

SEQ ID NO: 831547 - DNA, 20 bp, mouse
gcggaagtcgccaggcctgg

SEQ ID NO: 831548 - DNA, 20 bp, mouse
ggtggccagaggccactcgt

SEQ ID NO: 831549 - DNA, 20 bp, mouse
gtggcagtcaggcactagga

SEQ ID NO: 831550 - DNA, 20 bp, mouse
ggtgctgggagagagccccc

SEQ ID NO: 831551 - DNA, 20 bp, mouse
gaaatgcggggcgtggccag

SEQ ID NO: 831552 - DNA, 20 bp, mouse
gcggggcgccgaatcacccc

SEQ ID NO: 831553 - DNA, 20 bp, mouse
gtccaacagggcactgtgct

SEQ ID NO: 831554 - DNA, 20 bp, mouse
gagcatggctcagagttccg

SEQ ID NO: 831555 - DNA, 20 bp, mouse
gggccacgccccgcatttag

SEQ ID NO: 831556 - DNA, 20 bp, mouse
gtgactgggtcacagacttg

SEQ ID NO: 831557 - DNA, 20 bp, mouse
gactacatgcacaacaacaa

SEQ ID NO: 831558 - DNA, 20 bp, mouse
gcaagcgcggagggatcagt

SEQ ID NO: 831559 - DNA, 20 bp, mouse
gttgtggtggaggcatggac

SEQ ID NO: 831560 - DNA, 20 bp, mouse
gcgcacacgcttgcttatgg

SEQ ID NO: 831561 - DNA, 20 bp, mouse
ggagggatcagtcggtgaca

SEQ ID NO: 831562 - DNA, 20 bp, mouse
gaccgagataaacttgtgac

SEQ ID NO: 831563 - DNA, 20 bp, mouse
gtgcgcatgtgcaagcgcgg

SEQ ID NO: 831564 - DNA, 20 bp, mouse
gagcggaaggatacatgcgg

SEQ ID NO: 831565 - DNA, 20 bp, mouse
gcagacttgtggtggaggca

SEQ ID NO: 831566 - DNA, 20 bp, mouse
gcgcgcgcggcttaagacca

SEQ ID NO: 831567 - DNA, 20 bp, mouse
ggaggcagaagttcaaactg

SEQ ID NO: 831568 - DNA, 20 bp, mouse
gcggtcgcctggcaggttaa

SEQ ID NO: 831569 - DNA, 20 bp, mouse
gtgaaggcctcccacacaag

SEQ ID NO: 831570 - DNA, 20 bp, mouse
gtttcctaaggcatgatata

SEQ ID NO: 831571 - DNA, 20 bp, mouse
ggtaaacatcaaaattcctg

SEQ ID NO: 831572 - DNA, 20 bp, mouse
gatgcgcagactttcctcaa

SEQ ID NO: 831573 - DNA, 20 bp, mouse
ggaagtgttagtaggtaaaa

SEQ ID NO: 831574 - DNA, 20 bp, mouse
gtaaggcatgatatatggtt

SEQ ID NO: 831575 - DNA, 20 bp, mouse
gtaaaacttgaagtgttagt

SEQ ID NO: 831576 - DNA, 20 bp, mouse
ggcgaggccggtgtccccca

SEQ ID NO: 831577 - DNA, 20 bp, mouse
ggccccttcgcgctcgaagt

SEQ ID NO: 831578 - DNA, 20 bp, mouse
gggcgcctctgccgcgagga

SEQ ID NO: 831579 - DNA, 20 bp, mouse
gaggagcgaaggggccttga

SEQ ID NO: 831580 - DNA, 20 bp, mouse
gagggctccgcgaaactgtg

SEQ ID NO: 831581 - DNA, 20 bp, mouse
ggattccgggcggggccctg

SEQ ID NO: 831582 - DNA, 20 bp, mouse
gagtggggccgtacgcacga

SEQ ID NO: 831583 - DNA, 20 bp, mouse
gcagaggcggtgctgaatga

SEQ ID NO: 831584 - DNA, 20 bp, mouse
ggaagtcggccgattccggg

SEQ ID NO: 831585 - DNA, 20 bp, mouse
ggcagagaaagtcgggaagt

SEQ ID NO: 831586 - DNA, 20 bp, mouse
gctcgggtgaagccatggaa

SEQ ID NO: 831587 - DNA, 20 bp, mouse
gaccagtaggtgagagatga

SEQ ID NO: 831588 - DNA, 20 bp, mouse
ggccacctcgggtgaagcca

SEQ ID NO: 831589 - DNA, 20 bp, mouse
gggtgaagccatggaacgga

SEQ ID NO: 831590 - DNA, 20 bp, mouse
gcgggacgccatccgttcca

SEQ ID NO: 831591 - DNA, 20 bp, mouse
gcccccacctgactagtctg

SEQ ID NO: 831592 - DNA, 20 bp, mouse
gaatgagcagccgagagata

SEQ ID NO: 831593 - DNA, 20 bp, mouse
ggctcggagactagtggtgt

SEQ ID NO: 831594 - DNA, 20 bp, mouse
gagccccagactagtcaggt

SEQ ID NO: 831595 - DNA, 20 bp, mouse
gcaaggggctcggagactag

SEQ ID NO: 831596 - DNA, 20 bp, mouse
gacagcggaacacttgggga

SEQ ID NO: 831597 - DNA, 20 bp, mouse
gtgtaacagcggaacacttg

SEQ ID NO: 831598 - DNA, 20 bp, mouse
ggtgctaggaagctgctgaa

SEQ ID NO: 831599 - DNA, 20 bp, mouse
gaatgggattgtagttcacg

SEQ ID NO: 831600 - DNA, 20 bp, mouse
ggactcgccccccagaacta

SEQ ID NO: 831601 - DNA, 20 bp, mouse
ggaaaagggctactgagagg

SEQ ID NO: 831602 - DNA, 20 bp, mouse
gattgtagttcacggggagt

SEQ ID NO: 831603 - DNA, 20 bp, mouse
gtcgccccccagaactaggg

SEQ ID NO: 831604 - DNA, 20 bp, mouse
ggagtcagatcttaaccaat

SEQ ID NO: 831605 - DNA, 20 bp, mouse
gcatgagcaccaattggaaa

SEQ ID NO: 831606 - DNA, 20 bp, mouse
gggtaggcatggatccagtg

SEQ ID NO: 831607 - DNA, 20 bp, mouse
gtgctcacagacccaccccg

SEQ ID NO: 831608 - DNA, 20 bp, mouse
gcccaggccaagtggccacg

SEQ ID NO: 831609 - DNA, 20 bp, mouse
gctggggatcacaggtgaga

SEQ ID NO: 831610 - DNA, 20 bp, mouse
ggtgcctgggcacaccccac

SEQ ID NO: 831611 - DNA, 20 bp, mouse
gggtgggtctgtgagcaatt

SEQ ID NO: 831612 - DNA, 20 bp, mouse
ggatccagtggggtgtgccc

SEQ ID NO: 831613 - DNA, 20 bp, mouse
gcacttggcctggggatcac

SEQ ID NO: 831614 - DNA, 20 bp, mouse
gtctggaaaaggcactgaag

SEQ ID NO: 831615 - DNA, 20 bp, mouse
ggacccaccccgtggccact

SEQ ID NO: 831616 - DNA, 20 bp, mouse
gaggaggggcccaggcgagt

SEQ ID NO: 831617 - DNA, 20 bp, mouse
gcacagaggccgcgcgaggt

SEQ ID NO: 831618 - DNA, 20 bp, mouse
gcgaaggccaacacaggctg

SEQ ID NO: 831619 - DNA, 20 bp, mouse
gcaacgtggggcactgacgc

SEQ ID NO: 831620 - DNA, 20 bp, mouse
ggcgtgcgccgcaccaacgt

SEQ ID NO: 831621 - DNA, 20 bp, mouse
gcccaggcggccacggacgt

SEQ ID NO: 831622 - DNA, 20 bp, mouse
gtctccccgcccactcgcct

SEQ ID NO: 831623 - DNA, 20 bp, mouse
ggcgtctagccgctccccat

SEQ ID NO: 831624 - DNA, 20 bp, mouse
gcgcgaggtgggcggagcga

SEQ ID NO: 831625 - DNA, 20 bp, mouse
gttggtgcggcgcacgcggt

SEQ ID NO: 831626 - DNA, 20 bp, mouse
gcgcgcctctggagccgtgg

SEQ ID NO: 831627 - DNA, 20 bp, mouse
gaagccacttgcagccccca

SEQ ID NO: 831628 - DNA, 20 bp, mouse
ggcagcccccacggctccag

SEQ ID NO: 831629 - DNA, 20 bp, mouse
ggggcggcggtgccacctta

SEQ ID NO: 831630 - DNA, 20 bp, mouse
gtcggttccaagacccgctg

SEQ ID NO: 831631 - DNA, 20 bp, mouse
gaaccggggggagagaaatt

SEQ ID NO: 831632 - DNA, 20 bp, mouse
gtcccagccgagccccgcgg

SEQ ID NO: 831633 - DNA, 20 bp, mouse
gggcgggacccgccttaagg

SEQ ID NO: 831634 - DNA, 20 bp, mouse
gcggcggtgccaccttaagg

SEQ ID NO: 831635 - DNA, 20 bp, mouse
gggggtggggcgggaacact

SEQ ID NO: 831636 - DNA, 20 bp, mouse
gagtgcgaggctcccacgtg

SEQ ID NO: 831637 - DNA, 20 bp, mouse
ggagtcccgtggccccacgt

SEQ ID NO: 831638 - DNA, 20 bp, mouse
gcgaaagtcaccagcgggta

SEQ ID NO: 831639 - DNA, 20 bp, mouse
gtggcggcttcgcctagcgt

SEQ ID NO: 831640 - DNA, 20 bp, mouse
ggggagcctcgcactcccat

SEQ ID NO: 831641 - DNA, 20 bp, mouse
gtcgcctagcgttggccaat

SEQ ID NO: 831642 - DNA, 20 bp, mouse
gaggctcccacgtggggcca

SEQ ID NO: 831643 - DNA, 20 bp, mouse
gactcccattggccaacgct

SEQ ID NO: 831644 - DNA, 20 bp, mouse
gcgcgagagcagttccaaat

SEQ ID NO: 831645 - DNA, 20 bp, mouse
gccgctggtgactttcgctt

SEQ ID NO: 831646 - DNA, 20 bp, mouse
ggagagcgcgcggggctagc

SEQ ID NO: 831647 - DNA, 20 bp, mouse
ggggagatgtagtcctcgcg

SEQ ID NO: 831648 - DNA, 20 bp, mouse
ggagactgtagtcaatctgg

SEQ ID NO: 831649 - DNA, 20 bp, mouse
gctaggcccacgtggggaca

SEQ ID NO: 831650 - DNA, 20 bp, mouse
ggggcaggctaggcccacgt

SEQ ID NO: 831651 - DNA, 20 bp, mouse
ggggcgccgcatcaaccaat

SEQ ID NO: 831652 - DNA, 20 bp, mouse
ggctctccgcggcgctctcc

SEQ ID NO: 831653 - DNA, 20 bp, mouse
ggatggctgaacattaatcg

SEQ ID NO: 831654 - DNA, 20 bp, mouse
gagtcctcgcgcggctactg

SEQ ID NO: 831655 - DNA, 20 bp, mouse
gatgctccttgggccctccg

SEQ ID NO: 831656 - DNA, 20 bp, mouse
gcacctggcccctttctcaa

SEQ ID NO: 831657 - DNA, 20 bp, mouse
gagaaaggggccaggtggca

SEQ ID NO: 831658 - DNA, 20 bp, mouse
ggcccaaggccagatgtcac

SEQ ID NO: 831659 - DNA, 20 bp, mouse
gctcaagggcactggcagga

SEQ ID NO: 831660 - DNA, 20 bp, mouse
ggctggggacacacgtgtct

SEQ ID NO: 831661 - DNA, 20 bp, mouse
ggacacacgtgtcttggctt

SEQ ID NO: 831662 - DNA, 20 bp, mouse
gtggcaggggaaaggctgct

SEQ ID NO: 831663 - DNA, 20 bp, mouse
gctgccagtgcccttgagaa

SEQ ID NO: 831664 - DNA, 20 bp, mouse
gcaggcctgtagaggggcac

SEQ ID NO: 831665 - DNA, 20 bp, mouse
gaggtcctgtgcatgactag

SEQ ID NO: 831666 - DNA, 20 bp, mouse
ggaaggcggcgagcccacgt

SEQ ID NO: 831667 - DNA, 20 bp, mouse
ggaagcgtgtatcagggccc

SEQ ID NO: 831668 - DNA, 20 bp, mouse
gcaggccctgaccaatcaga

SEQ ID NO: 831669 - DNA, 20 bp, mouse
gcccacgtgcaccgtggcct

SEQ ID NO: 831670 - DNA, 20 bp, mouse
ggggctcgccgccttctgat

SEQ ID NO: 831671 - DNA, 20 bp, mouse
gccggggcccacgtgcaccg

SEQ ID NO: 831672 - DNA, 20 bp, mouse
gcgccccctgcacccaccga

SEQ ID NO: 831673 - DNA, 20 bp, mouse
ggccgccttctgattggtca

SEQ ID NO: 831674 - DNA, 20 bp, mouse
gtctggctcgcagcccacgt

SEQ ID NO: 831675 - DNA, 20 bp, mouse
gccgagggaagcgtgtatca

SEQ ID NO: 831676 - DNA, 20 bp, mouse
gtggctccggagtctcaaaa

SEQ ID NO: 831677 - DNA, 20 bp, mouse
ggagcggcgagtcgcgtgcg

SEQ ID NO: 831678 - DNA, 20 bp, mouse
gccgaccgaggccacttccg

SEQ ID NO: 831679 - DNA, 20 bp, mouse
ggagcagaggcgtctcgggc

SEQ ID NO: 831680 - DNA, 20 bp, mouse
ggtggggcgcgcttcggagc

SEQ ID NO: 831681 - DNA, 20 bp, mouse
gcgtgcgcggagccggccgg

SEQ ID NO: 831682 - DNA, 20 bp, mouse
gggggcccgacgcactgcag

SEQ ID NO: 831683 - DNA, 20 bp, mouse
ggaggcgtctcgggcaggct

SEQ ID NO: 831684 - DNA, 20 bp, mouse
ggcgcctccggtagcagcgg

SEQ ID NO: 831685 - DNA, 20 bp, mouse
gcggtgggtggcggctgagg

SEQ ID NO: 831686 - DNA, 20 bp, mouse
gcggccccgcctgcgacgtg

SEQ ID NO: 831687 - DNA, 20 bp, mouse
gggaacaggccgcgcctgac

SEQ ID NO: 831688 - DNA, 20 bp, mouse
gcgccagcgcggccgctgat

SEQ ID NO: 831689 - DNA, 20 bp, mouse
gggcgggcaggggttaacca

SEQ ID NO: 831690 - DNA, 20 bp, mouse
gcgcggccgctgattggagg

SEQ ID NO: 831691 - DNA, 20 bp, mouse
gcagcgcggccgctgattgg

SEQ ID NO: 831692 - DNA, 20 bp, mouse
gtaaccaggggaccccgcac

SEQ ID NO: 831693 - DNA, 20 bp, mouse
gtccgactctgtctccacaa

SEQ ID NO: 831694 - DNA, 20 bp, mouse
gccgccggtgcggggtcccc

SEQ ID NO: 831695 - DNA, 20 bp, mouse
gaatccggatcggttcggtc

SEQ ID NO: 831696 - DNA, 20 bp, mouse
gtcaaacgaagtcagagagg

SEQ ID NO: 831697 - DNA, 20 bp, mouse
gtaagcaggatgcgagtgat

SEQ ID NO: 831698 - DNA, 20 bp, mouse
gcgactgcccggagagcaaa

SEQ ID NO: 831699 - DNA, 20 bp, mouse
gcctcgcgccacccccggtc

SEQ ID NO: 831700 - DNA, 20 bp, mouse
ggcaaaggggtgtgaggatt

SEQ ID NO: 831701 - DNA, 20 bp, mouse
ggaactgaaaggggagaccg

SEQ ID NO: 831702 - DNA, 20 bp, mouse
gaaaagacagcctagagggg

SEQ ID NO: 831703 - DNA, 20 bp, mouse
gggtaaaaagacagcctaga

SEQ ID NO: 831704 - DNA, 20 bp, mouse
gtaaaagcctgccgaagcta

SEQ ID NO: 831705 - DNA, 20 bp, mouse
gaaaacaggcatctgtgcaa

SEQ ID NO: 831706 - DNA, 20 bp, mouse
gtgcacctccgtaacttcgg

SEQ ID NO: 831707 - DNA, 20 bp, mouse
ggaagatgctgacaagtgtt

SEQ ID NO: 831708 - DNA, 20 bp, mouse
gcctaggacgcataagtgat

SEQ ID NO: 831709 - DNA, 20 bp, mouse
gagggcgtgtggtccagccc

SEQ ID NO: 831710 - DNA, 20 bp, mouse
ggctccgcccctctccacca

SEQ ID NO: 831711 - DNA, 20 bp, mouse
ggaccacacgccctctccaa

SEQ ID NO: 831712 - DNA, 20 bp, mouse
gctgtccggggcccttggag

SEQ ID NO: 831713 - DNA, 20 bp, mouse
gccctgcacctccgtaactt

SEQ ID NO: 831714 - DNA, 20 bp, mouse
gggttcctccgaagttacgg

SEQ ID NO: 831715 - DNA, 20 bp, mouse
gcaaacccgaagttgtgggt

SEQ ID NO: 831716 - DNA, 20 bp, mouse
gaatccccgccctggggcgt

SEQ ID NO: 831717 - DNA, 20 bp, mouse
gccccagggcggggattctg

SEQ ID NO: 831718 - DNA, 20 bp, mouse
ggggctgcgccacgtcccgg

SEQ ID NO: 831719 - DNA, 20 bp, mouse
gcaactcggaagtggctcct

SEQ ID NO: 831720 - DNA, 20 bp, mouse
gggcccgcgctctatggtag

SEQ ID NO: 831721 - DNA, 20 bp, mouse
gagactgcaggaagctgctc

SEQ ID NO: 831722 - DNA, 20 bp, mouse
gtcaagcttcccacgcccca

SEQ ID NO: 831723 - DNA, 20 bp, mouse
gctcgcttcctgctggggag

SEQ ID NO: 831724 - DNA, 20 bp, mouse
gcaagtcccaggattccacg

SEQ ID NO: 831725 - DNA, 20 bp, mouse
ggccctgggcccgcgctcta

SEQ ID NO: 831726 - DNA, 20 bp, mouse
gtatcccgggagtctcttga

SEQ ID NO: 831727 - DNA, 20 bp, mouse
gcccgggagtctcttgaagg

SEQ ID NO: 831728 - DNA, 20 bp, mouse
gggcagaacccaggtgttat

SEQ ID NO: 831729 - DNA, 20 bp, mouse
gccagctggcctataacacc

SEQ ID NO: 831730 - DNA, 20 bp, mouse
gaaagaaagtcctgcccagc

SEQ ID NO: 831731 - DNA, 20 bp, mouse
gtactcgtaattggtatcca

SEQ ID NO: 831732 - DNA, 20 bp, mouse
ggcctccttcaagagactcc

SEQ ID NO: 831733 - DNA, 20 bp, mouse
gtcattcctggggatcagag

SEQ ID NO: 831734 - DNA, 20 bp, mouse
gggctctgagctgtcttgag

SEQ ID NO: 831735 - DNA, 20 bp, mouse
gtcagaatcttcactggtct

SEQ ID NO: 831736 - DNA, 20 bp, mouse
ggcaggcagatctaagtgtg

SEQ ID NO: 831737 - DNA, 20 bp, mouse
ggccagttctaagaccacca

SEQ ID NO: 831738 - DNA, 20 bp, mouse
ggtggagagtccagtaaatg

SEQ ID NO: 831739 - DNA, 20 bp, mouse
gcctgctgcccgcaccctaa

SEQ ID NO: 831740 - DNA, 20 bp, mouse
ggtgggggacaccattgtat

SEQ ID NO: 831741 - DNA, 20 bp, mouse
gagcggagagcaatgaacgc

SEQ ID NO: 831742 - DNA, 20 bp, mouse
ggagagtccagtaaatgtgg

SEQ ID NO: 831743 - DNA, 20 bp, mouse
ggggacaccattgtatgggc

SEQ ID NO: 831744 - DNA, 20 bp, mouse
gcaagactactgcctttacc

SEQ ID NO: 831745 - DNA, 20 bp, mouse
ggtacagtccattagggtgc

SEQ ID NO: 831746 - DNA, 20 bp, mouse
gtgaactggtagactgtcat

SEQ ID NO: 831747 - DNA, 20 bp, mouse
ggctgtgaatgctggatctg

SEQ ID NO: 831748 - DNA, 20 bp, mouse
gctacggtggctgtgaatgc

SEQ ID NO: 831749 - DNA, 20 bp, mouse
gtaccagttcaccctattag

SEQ ID NO: 831750 - DNA, 20 bp, mouse
gcattgttgtccccactaat

SEQ ID NO: 831751 - DNA, 20 bp, mouse
gcacagccaccgtagtaagc

SEQ ID NO: 831752 - DNA, 20 bp, mouse
gaatgctggatctgtggttc

SEQ ID NO: 831753 - DNA, 20 bp, mouse
gtccaacctgcttactacgg

SEQ ID NO: 831754 - DNA, 20 bp, mouse
gagaaaagatgatttgtgag

SEQ ID NO: 831755 - DNA, 20 bp, mouse
gccccactaatagggtgaac

SEQ ID NO: 831756 - DNA, 20 bp, mouse
ggaaacgtatggagtgtact

SEQ ID NO: 831757 - DNA, 20 bp, mouse
ggatctgagcatcacatcgc

SEQ ID NO: 831758 - DNA, 20 bp, mouse
gatggagtgtactaggaaag

SEQ ID NO: 831759 - DNA, 20 bp, mouse
gctgtctcttaaagtaagag

SEQ ID NO: 831760 - DNA, 20 bp, mouse
ggtagtctgaagacaaagga

SEQ ID NO: 831761 - DNA, 20 bp, mouse
gtggaacctcaccagatttg

SEQ ID NO: 831762 - DNA, 20 bp, mouse
gagactgctttttcagatgt

SEQ ID NO: 831763 - DNA, 20 bp, mouse
ggtggggaatgacttctcct

SEQ ID NO: 831764 - DNA, 20 bp, mouse
gatgtgagaactgaaacgta

SEQ ID NO: 831765 - DNA, 20 bp, mouse
gtgcagccccaaatctggtg

SEQ ID NO: 831766 - DNA, 20 bp, mouse
ggacaccagggcaacgtagg

SEQ ID NO: 831767 - DNA, 20 bp, mouse
gagggaggggaaatgacacc

SEQ ID NO: 831768 - DNA, 20 bp, mouse
gagcactgaggcttcgaggg

SEQ ID NO: 831769 - DNA, 20 bp, mouse
gcagggcaacgtagggggat

SEQ ID NO: 831770 - DNA, 20 bp, mouse
gactagaacagtctgcagtg

SEQ ID NO: 831771 - DNA, 20 bp, mouse
gtgcagtgtggttagacccc

SEQ ID NO: 831772 - DNA, 20 bp, mouse
gttacttccacccccagggc

SEQ ID NO: 831773 - DNA, 20 bp, mouse
gtcttaacaaactgagctcg

SEQ ID NO: 831774 - DNA, 20 bp, mouse
gcacacacacaagtagagtc

SEQ ID NO: 831775 - DNA, 20 bp, mouse
gcttggacagaagagaacac

SEQ ID NO: 831776 - DNA, 20 bp, mouse
gaactcaggggatctatggt

SEQ ID NO: 831777 - DNA, 20 bp, mouse
gtacacggcaagtaactcag

SEQ ID NO: 831778 - DNA, 20 bp, mouse
gaagtaactcaggggatcta

SEQ ID NO: 831779 - DNA, 20 bp, mouse
gaaggaatggggccaggtac

SEQ ID NO: 831780 - DNA, 20 bp, mouse
ggcgaaagaggcgggcaagg

SEQ ID NO: 831781 - DNA, 20 bp, mouse
ggtggtggatgaagagtcaa

SEQ ID NO: 831782 - DNA, 20 bp, mouse
gtgcaaagtacagtcttgaa

SEQ ID NO: 831783 - DNA, 20 bp, mouse
gtaggcatggcgaaagaggc

SEQ ID NO: 831784 - DNA, 20 bp, mouse
gttgccgtgtaggctcattt

SEQ ID NO: 831785 - DNA, 20 bp, mouse
ggcaacaccaagacatgatc

SEQ ID NO: 831786 - DNA, 20 bp, mouse
gcgcccacaggggtctgcaa

SEQ ID NO: 831787 - DNA, 20 bp, mouse
gcacctggggaattcccaca

SEQ ID NO: 831788 - DNA, 20 bp, mouse
gctggcgaccgggaagttcg

SEQ ID NO: 831789 - DNA, 20 bp, mouse
gctgctgcaaggattctgga

SEQ ID NO: 831790 - DNA, 20 bp, mouse
gaagttcggggccctgacct

SEQ ID NO: 831791 - DNA, 20 bp, mouse
gaggggatgtccccaggtca

SEQ ID NO: 831792 - DNA, 20 bp, mouse
gaagtccagaggctccgtgt

SEQ ID NO: 831793 - DNA, 20 bp, mouse
gctccgtgtgggaattcccc

SEQ ID NO: 831794 - DNA, 20 bp, mouse
ggatggctgaatgactcggg

SEQ ID NO: 831795 - DNA, 20 bp, mouse
gtcctgccagctctgatgcc

SEQ ID NO: 831796 - DNA, 20 bp, mouse
ggggcctgcttgagtaagaa

SEQ ID NO: 831797 - DNA, 20 bp, mouse
gaccggccgtgtggggaaat

SEQ ID NO: 831798 - DNA, 20 bp, mouse
gaggccgggaaataacaatg

SEQ ID NO: 831799 - DNA, 20 bp, mouse
ggggaggggccaacagggac

SEQ ID NO: 831800 - DNA, 20 bp, mouse
gtaaagaaacggagttgcaa

SEQ ID NO: 831801 - DNA, 20 bp, mouse
gcagaagtttggtccagcac

SEQ ID NO: 831802 - DNA, 20 bp, mouse
gataaagcgaggtaagtgaa

SEQ ID NO: 831803 - DNA, 20 bp, mouse
gaggacatctcggacacagg

SEQ ID NO: 831804 - DNA, 20 bp, mouse
ggaatcgcgcatagtgggag

SEQ ID NO: 831805 - DNA, 20 bp, mouse
gacatctcggacacaggagg

SEQ ID NO: 831806 - DNA, 20 bp, mouse
gctcccagagcacagtatta

SEQ ID NO: 831807 - DNA, 20 bp, mouse
gagtccctaatactgtgctc

SEQ ID NO: 831808 - DNA, 20 bp, mouse
gaggaagtcatctgacctct

SEQ ID NO: 831809 - DNA, 20 bp, mouse
ggatctgccccgtcgcagga

SEQ ID NO: 831810 - DNA, 20 bp, mouse
gtgaaggcagggaactggcg

SEQ ID NO: 831811 - DNA, 20 bp, mouse
gaatgaacacgtacacacat

SEQ ID NO: 831812 - DNA, 20 bp, mouse
gctgccttcaccaagcccag

SEQ ID NO: 831813 - DNA, 20 bp, mouse
gcagaggggcacccactggg

SEQ ID NO: 831814 - DNA, 20 bp, mouse
gcgactggaggaacagcaag

SEQ ID NO: 831815 - DNA, 20 bp, mouse
ggaagactgaagactagaac

SEQ ID NO: 831816 - DNA, 20 bp, mouse
gtggggcagacggtaggtat

SEQ ID NO: 831817 - DNA, 20 bp, mouse
gcagagaggtacctaggctg

SEQ ID NO: 831818 - DNA, 20 bp, mouse
gccctggcaagaaagcagag

SEQ ID NO: 831819 - DNA, 20 bp, mouse
gtgcactgacccagggaagg

SEQ ID NO: 831820 - DNA, 20 bp, mouse
gtagagctggggcagacggt

SEQ ID NO: 831821 - DNA, 20 bp, mouse
gcaggcctatgttatctcga

SEQ ID NO: 831822 - DNA, 20 bp, mouse
ggagatagaggtctcctccc

SEQ ID NO: 831823 - DNA, 20 bp, mouse
gtatctcgatggacagttag

SEQ ID NO: 831824 - DNA, 20 bp, mouse
gccgcccacaactcttgatc

SEQ ID NO: 831825 - DNA, 20 bp, mouse
gctatcatggagcccagcac

SEQ ID NO: 831826 - DNA, 20 bp, mouse
gaaacccttccaaagcagag

SEQ ID NO: 831827 - DNA, 20 bp, mouse
gcctgggaaccacggtactt

SEQ ID NO: 831828 - DNA, 20 bp, mouse
ggaaccacggtacttaggag

SEQ ID NO: 831829 - DNA, 20 bp, mouse
ggtcctaagcctgggaacca

SEQ ID NO: 831830 - DNA, 20 bp, mouse
gttggaagggttttatacac

SEQ ID NO: 831831 - DNA, 20 bp, mouse
gtgacagtggtgattttgta

SEQ ID NO: 831832 - DNA, 20 bp, mouse
gcgggaagagcaagcgatgc

SEQ ID NO: 831833 - DNA, 20 bp, mouse
gtactacgagtatttattta

SEQ ID NO: 831834 - DNA, 20 bp, mouse
ggagcccctctgctttggaa

SEQ ID NO: 831835 - DNA, 20 bp, mouse
gtgccaccaggatagaagtt

SEQ ID NO: 831836 - DNA, 20 bp, mouse
gggaatctgaagctagactg

SEQ ID NO: 831837 - DNA, 20 bp, mouse
gcgggggttgcagaaacacc

SEQ ID NO: 831838 - DNA, 20 bp, mouse
gaaggacaggttgctttatc

SEQ ID NO: 831839 - DNA, 20 bp, mouse
gtcaatagtgagctggcgag

SEQ ID NO: 831840 - DNA, 20 bp, mouse
gctaacctcagtactatgca

SEQ ID NO: 831841 - DNA, 20 bp, mouse
gtctaccctgcatagtactg

SEQ ID NO: 831842 - DNA, 20 bp, mouse
gtgtttctgcaacccccgtg

SEQ ID NO: 831843 - DNA, 20 bp, mouse
gaaaattgaggctgggtagt

SEQ ID NO: 831844 - DNA, 20 bp, mouse
gacttaacttacaccacacg

SEQ ID NO: 831845 - DNA, 20 bp, mouse
ggttgctttatcaggttgtt

SEQ ID NO: 831846 - DNA, 20 bp, mouse
gcagcatggcagtcttgaaa

SEQ ID NO: 831847 - DNA, 20 bp, mouse
gttgggtaagcaggattagg

SEQ ID NO: 831848 - DNA, 20 bp, mouse
gctgcttacccaaaccctac

SEQ ID NO: 831849 - DNA, 20 bp, mouse
gatgtctatggatacctgta

SEQ ID NO: 831850 - DNA, 20 bp, mouse
ggggaaacaggcaataaaat

SEQ ID NO: 831851 - DNA, 20 bp, mouse
gggtttgggtaagcaggatt

SEQ ID NO: 831852 - DNA, 20 bp, mouse
gctgttgccaaatcacttat

SEQ ID NO: 831853 - DNA, 20 bp, mouse
gcaagactgccatgctgcat

SEQ ID NO: 831854 - DNA, 20 bp, mouse
gtcattgagtgagagcaaga

SEQ ID NO: 831855 - DNA, 20 bp, mouse
gagaagtgccccagctacag

SEQ ID NO: 831856 - DNA, 20 bp, mouse
gccaccccacaatcagccaa

SEQ ID NO: 831857 - DNA, 20 bp, mouse
gccaccccccaaagagctgt

SEQ ID NO: 831858 - DNA, 20 bp, mouse
ggcctcagtgcctgtctcat

SEQ ID NO: 831859 - DNA, 20 bp, mouse
gagcactgaccctcgtgagg

SEQ ID NO: 831860 - DNA, 20 bp, mouse
gaggtgacaccctcctcacg

SEQ ID NO: 831861 - DNA, 20 bp, mouse
ggataccctttggctgattg

SEQ ID NO: 831862 - DNA, 20 bp, mouse
gccttcccacagctctttgg

SEQ ID NO: 831863 - DNA, 20 bp, mouse
gccgagagcacccatgagac

SEQ ID NO: 831864 - DNA, 20 bp, mouse
gcagagcactgaccctcgtg

SEQ ID NO: 831865 - DNA, 20 bp, mouse
gtgtaccacctgctctttca

SEQ ID NO: 831866 - DNA, 20 bp, mouse
gggctgtgcgtggagaggag

SEQ ID NO: 831867 - DNA, 20 bp, mouse
gtctggctccggcatctgtc

SEQ ID NO: 831868 - DNA, 20 bp, mouse
gggggtgaatgacagcgcgg

SEQ ID NO: 831869 - DNA, 20 bp, mouse
gagacccggccgaaacagct

SEQ ID NO: 831870 - DNA, 20 bp, mouse
gagcggggtgaatgacagcg

SEQ ID NO: 831871 - DNA, 20 bp, mouse
gcgagcgagcagccggagaa

SEQ ID NO: 831872 - DNA, 20 bp, mouse
gctgtccccaggggcctagt

SEQ ID NO: 831873 - DNA, 20 bp, mouse
ggggcccgggctccatacct

SEQ ID NO: 831874 - DNA, 20 bp, mouse
gctcgctcgctgttgactct

SEQ ID NO: 831875 - DNA, 20 bp, mouse
gtctctccattggctgtgcg

SEQ ID NO: 831876 - DNA, 20 bp, mouse
gaacccgggagccagtccga

SEQ ID NO: 831877 - DNA, 20 bp, mouse
ggagggcgcgggtatcagga

SEQ ID NO: 831878 - DNA, 20 bp, mouse
gccgctgcccgagtccggtg

SEQ ID NO: 831879 - DNA, 20 bp, mouse
gctggccagcggcacccatc

SEQ ID NO: 831880 - DNA, 20 bp, mouse
ggcggggccccgctgttaaa

SEQ ID NO: 831881 - DNA, 20 bp, mouse
gcgagcgcccgcatcttcgc

SEQ ID NO: 831882 - DNA, 20 bp, mouse
gaggggccgctgactcagcc

SEQ ID NO: 831883 - DNA, 20 bp, mouse
ggaggcgaagagtggggtct

SEQ ID NO: 831884 - DNA, 20 bp, mouse
gccccgctgttaaaggggaa

SEQ ID NO: 831885 - DNA, 20 bp, mouse
gcaggggcagtgactcgggt

SEQ ID NO: 831886 - DNA, 20 bp, mouse
gtattagccgggataatggg

SEQ ID NO: 831887 - DNA, 20 bp, mouse
gggctcccggctttcaataa

SEQ ID NO: 831888 - DNA, 20 bp, mouse
ggcgggagaggaattagcag

SEQ ID NO: 831889 - DNA, 20 bp, mouse
gcgggtgcggcggcgggaaa

SEQ ID NO: 831890 - DNA, 20 bp, mouse
gtatccgccgcccattatcc

SEQ ID NO: 831891 - DNA, 20 bp, mouse
gagcagacgctccccgctcc

SEQ ID NO: 831892 - DNA, 20 bp, mouse
gaggcctaattcatggaaat

SEQ ID NO: 831893 - DNA, 20 bp, mouse
gccccagcagcgcctacggg

SEQ ID NO: 831894 - DNA, 20 bp, mouse
gggtttgagaagctgcggtt

SEQ ID NO: 831895 - DNA, 20 bp, mouse
gaacggtcctacgaaatctg

SEQ ID NO: 831896 - DNA, 20 bp, mouse
gacatcagcgaggttttcga

SEQ ID NO: 831897 - DNA, 20 bp, mouse
ggccgcctggcccgcgggtc

SEQ ID NO: 831898 - DNA, 20 bp, mouse
ggctgtgccaagttatccta

SEQ ID NO: 831899 - DNA, 20 bp, mouse
gcgtcacgagccacagggtg

SEQ ID NO: 831900 - DNA, 20 bp, mouse
ggcaaccgtggcgcagctta

SEQ ID NO: 831901 - DNA, 20 bp, mouse
ggcgaccgtcacgagccaca

SEQ ID NO: 831902 - DNA, 20 bp, mouse
gtaaaggggcctggcaaccg

SEQ ID NO: 831903 - DNA, 20 bp, mouse
gagcagtctccctgggacat

SEQ ID NO: 831904 - DNA, 20 bp, mouse
gaaccggaagcgcgaggacg

SEQ ID NO: 831905 - DNA, 20 bp, mouse
gtggcacagctacatcagcg

SEQ ID NO: 831906 - DNA, 20 bp, mouse
ggctgcacggagcggaggga

SEQ ID NO: 831907 - DNA, 20 bp, mouse
gcgctccgtgcagcagtgaa

SEQ ID NO: 831908 - DNA, 20 bp, mouse
ggggttgcaaggatgaccga

SEQ ID NO: 831909 - DNA, 20 bp, mouse
gcactgctgcacggagcgga

SEQ ID NO: 831910 - DNA, 20 bp, mouse
gggagcgtcgagctgcgcac

SEQ ID NO: 831911 - DNA, 20 bp, mouse
ggcggccagaggctgacgta

SEQ ID NO: 831912 - DNA, 20 bp, mouse
ggggttggctgtggaacgga

SEQ ID NO: 831913 - DNA, 20 bp, mouse
gcgggcgcgaactggagcgg

SEQ ID NO: 831914 - DNA, 20 bp, mouse
ggcagtgaagggtctactgg

SEQ ID NO: 831915 - DNA, 20 bp, mouse
gcgcccctccgcccgctcag

SEQ ID NO: 831916 - DNA, 20 bp, mouse
ggcccgcaggcgcactgctg

SEQ ID NO: 831917 - DNA, 20 bp, mouse
ggggaagcaatgacacccgc

SEQ ID NO: 831918 - DNA, 20 bp, mouse
gcactcagagcacggcgaca

SEQ ID NO: 831919 - DNA, 20 bp, mouse
gcactgctgcggggcgccgc

SEQ ID NO: 831920 - DNA, 20 bp, mouse
gaaacggttgtgatgcgatg

SEQ ID NO: 831921 - DNA, 20 bp, mouse
ggccctgggtcctggtgcat

SEQ ID NO: 831922 - DNA, 20 bp, mouse
ggcttcccagctcggaggtt

SEQ ID NO: 831923 - DNA, 20 bp, mouse
gccaggaggcggggctgtgg

SEQ ID NO: 831924 - DNA, 20 bp, mouse
gtctgagtgctgttggccaa

SEQ ID NO: 831925 - DNA, 20 bp, mouse
gccccgcagcagtgcgcctg

SEQ ID NO: 831926 - DNA, 20 bp, mouse
gggacaacgaaaccagtagt

SEQ ID NO: 831927 - DNA, 20 bp, mouse
ggctcacaggataaagacga

SEQ ID NO: 831928 - DNA, 20 bp, mouse
gctgtgagcaagcggtatag

SEQ ID NO: 831929 - DNA, 20 bp, mouse
gcccttcaaatgaaatcctt

SEQ ID NO: 831930 - DNA, 20 bp, mouse
gagactccggttggggtgga

SEQ ID NO: 831931 - DNA, 20 bp, mouse
ggacccagggaacccagcta

SEQ ID NO: 831932 - DNA, 20 bp, mouse
gagactggaaacggtccaaa

SEQ ID NO: 831933 - DNA, 20 bp, mouse
gccagacttcagactccggt

SEQ ID NO: 831934 - DNA, 20 bp, mouse
gtggtccagacttcagactc

SEQ ID NO: 831935 - DNA, 20 bp, mouse
gtccgtctctaagcagttac

SEQ ID NO: 831936 - DNA, 20 bp, mouse
gacgacgaggctgagaaagt

SEQ ID NO: 831937 - DNA, 20 bp, mouse
gaagtgagcagagaatgagt

SEQ ID NO: 831938 - DNA, 20 bp, mouse
gtggagcagctgatgtggaa

SEQ ID NO: 831939 - DNA, 20 bp, mouse
gccggatggagcagctgatg

SEQ ID NO: 831940 - DNA, 20 bp, mouse
ggatgtggaaagggcgctgg

SEQ ID NO: 831941 - DNA, 20 bp, mouse
gaggctgagggactgctcct

SEQ ID NO: 831942 - DNA, 20 bp, mouse
gatgagtgggtcacgagcac

SEQ ID NO: 831943 - DNA, 20 bp, mouse
gaagaaagggtgggtgctca

SEQ ID NO: 831944 - DNA, 20 bp, mouse
ggccctgtgcttgaacacga

SEQ ID NO: 831945 - DNA, 20 bp, mouse
ggaagagcccagatggtaca

SEQ ID NO: 831946 - DNA, 20 bp, mouse
gagggcaggatgttattgtg

SEQ ID NO: 831947 - DNA, 20 bp, mouse
gttacaaggcacatcagtag

SEQ ID NO: 831948 - DNA, 20 bp, mouse
gtgaacttacacatgaatac

SEQ ID NO: 831949 - DNA, 20 bp, mouse
gcctatcataatatgattat

SEQ ID NO: 831950 - DNA, 20 bp, mouse
ggttcagagtccagtagggc

SEQ ID NO: 831951 - DNA, 20 bp, mouse
gagcagttcagagtccagta

SEQ ID NO: 831952 - DNA, 20 bp, mouse
gaacgttgggataaaaggcc

SEQ ID NO: 831953 - DNA, 20 bp, mouse
ggttattgtgaggattatga

SEQ ID NO: 831954 - DNA, 20 bp, mouse
gtgaacattgtataagatta

SEQ ID NO: 831955 - DNA, 20 bp, mouse
gacttatgaaaaatgagttg

SEQ ID NO: 831956 - DNA, 20 bp, mouse
ggagagagagacatagagtc

SEQ ID NO: 831957 - DNA, 20 bp, mouse
gaatgtcttgtctgtgctgg

SEQ ID NO: 831958 - DNA, 20 bp, mouse
gagggaatacttctttattt

SEQ ID NO: 831959 - DNA, 20 bp, mouse
gagacattatgaaattaaag

SEQ ID NO: 831960 - DNA, 20 bp, mouse
ggattattaacagaggttat

SEQ ID NO: 831961 - DNA, 20 bp, mouse
ggttgttgcaattgaagaga

SEQ ID NO: 831962 - DNA, 20 bp, mouse
gaaaacgtaatctcatttat

SEQ ID NO: 831963 - DNA, 20 bp, mouse
ggtgatgtatataatgccca

SEQ ID NO: 831964 - DNA, 20 bp, mouse
gcacggaaagcctgaaacac

SEQ ID NO: 831965 - DNA, 20 bp, mouse
gtggaattgcttctctatta

SEQ ID NO: 831966 - DNA, 20 bp, mouse
ggcgggagctgattgtacaa

SEQ ID NO: 831967 - DNA, 20 bp, mouse
gggaggggctgcagctggag

SEQ ID NO: 831968 - DNA, 20 bp, mouse
ggtaacaactgagacttcca

SEQ ID NO: 831969 - DNA, 20 bp, mouse
gtgcccagagagctgttgta

SEQ ID NO: 831970 - DNA, 20 bp, mouse
gactcgcaatgataagagag

SEQ ID NO: 831971 - DNA, 20 bp, mouse
gggtgtggcagtaggcgctg

SEQ ID NO: 831972 - DNA, 20 bp, mouse
gccggagttaaacaggtggg

SEQ ID NO: 831973 - DNA, 20 bp, mouse
gcaaaggtgtacacagacca

SEQ ID NO: 831974 - DNA, 20 bp, mouse
gtgtacaagggaaggtgact

SEQ ID NO: 831975 - DNA, 20 bp, mouse
gcagcccctccacttcctca

SEQ ID NO: 831976 - DNA, 20 bp, mouse
gggcagctgtgtgtagggaa

SEQ ID NO: 831977 - DNA, 20 bp, mouse
ggcccgcaggcccgcgagat

SEQ ID NO: 831978 - DNA, 20 bp, mouse
gggcactggaacattggttg

SEQ ID NO: 831979 - DNA, 20 bp, mouse
gggcggtgagtgagcaacca

SEQ ID NO: 831980 - DNA, 20 bp, mouse
gggtgagtgagcaaccaagg

SEQ ID NO: 831981 - DNA, 20 bp, mouse
gagggaaggggtgcgcgcgg

SEQ ID NO: 831982 - DNA, 20 bp, mouse
gttgatggcagctgtgtgta

SEQ ID NO: 831983 - DNA, 20 bp, mouse
gtgagccaagggccagcaga

SEQ ID NO: 831984 - DNA, 20 bp, mouse
gtgtagggaaggggtgcgcg

SEQ ID NO: 831985 - DNA, 20 bp, mouse
ggtctctgagccgatctcgc

SEQ ID NO: 831986 - DNA, 20 bp, mouse
gagagtgggtggtatacacc

SEQ ID NO: 831987 - DNA, 20 bp, mouse
gccggtaggtctccacacca

SEQ ID NO: 831988 - DNA, 20 bp, mouse
gtgcttgtagcgtctctgag

SEQ ID NO: 831989 - DNA, 20 bp, mouse
gctctgggaacgaggaagaa

SEQ ID NO: 831990 - DNA, 20 bp, mouse
gcgtctctgagtggcagtgg

SEQ ID NO: 831991 - DNA, 20 bp, mouse
gagaaggaggctgggtctgt

SEQ ID NO: 831992 - DNA, 20 bp, mouse
gaaggttatctggagatctc

SEQ ID NO: 831993 - DNA, 20 bp, mouse
ggaacggaaggggaaatgat

SEQ ID NO: 831994 - DNA, 20 bp, mouse
ggcacgtgatgaaggttatc

SEQ ID NO: 831995 - DNA, 20 bp, mouse
gggggatgaacagaacggaa

SEQ ID NO: 831996 - DNA, 20 bp, mouse
gcatggctgcagatgtggga

SEQ ID NO: 831997 - DNA, 20 bp, mouse
gtcagccccacaggtgacta

SEQ ID NO: 831998 - DNA, 20 bp, mouse
gactgagaaagggagcttat

SEQ ID NO: 831999 - DNA, 20 bp, mouse
gacgctgtgcaatggataaa

SEQ ID NO: 832000 - DNA, 20 bp, mouse
gggcggagtctcctgatagt

SEQ ID NO: 832001 - DNA, 20 bp, mouse
gggagtgccgccctactatc

SEQ ID NO: 832002 - DNA, 20 bp, mouse
ggagtctcctgatagtaggg

SEQ ID NO: 832003 - DNA, 20 bp, mouse
gataagctgggtagaggtaa

SEQ ID NO: 832004 - DNA, 20 bp, mouse
gggggcatggctgcagatgt

SEQ ID NO: 832005 - DNA, 20 bp, mouse
ggagaaagggagcttatggg

SEQ ID NO: 832006 - DNA, 20 bp, mouse
gccagcggggaagggcctct

SEQ ID NO: 832007 - DNA, 20 bp, mouse
ggggctactacgcgactcgt

SEQ ID NO: 832008 - DNA, 20 bp, mouse
gcactgaaacccaacccggg

SEQ ID NO: 832009 - DNA, 20 bp, mouse
ggctggcgcctcagaagctt

SEQ ID NO: 832010 - DNA, 20 bp, mouse
gtgaacccgccagcggggaa

SEQ ID NO: 832011 - DNA, 20 bp, mouse
gaggagcaggtggaacatgg

SEQ ID NO: 832012 - DNA, 20 bp, mouse
gcggcactgaaacccaaccc

SEQ ID NO: 832013 - DNA, 20 bp, mouse
gaggacttgagagagctctt

SEQ ID NO: 832014 - DNA, 20 bp, mouse
gcagggaggacagggcgata

SEQ ID NO: 832015 - DNA, 20 bp, mouse
gcctaccggcctatctgcct

SEQ ID NO: 832016 - DNA, 20 bp, mouse
gaggaggcgcgcgcccgcaa

SEQ ID NO: 832017 - DNA, 20 bp, mouse
ggggcgcgcgcctcctgccg

SEQ ID NO: 832018 - DNA, 20 bp, mouse
gcaaaagcaagaactcgtcc

SEQ ID NO: 832019 - DNA, 20 bp, mouse
gcgtccccggccggcccttg

SEQ ID NO: 832020 - DNA, 20 bp, mouse
gcgggctcacggggcaagcc

SEQ ID NO: 832021 - DNA, 20 bp, mouse
gcggggcttctgggctcccc

SEQ ID NO: 832022 - DNA, 20 bp, mouse
gtgggctccccgggctcacg

SEQ ID NO: 832023 - DNA, 20 bp, mouse
gcgcccgcaagggccggccg

SEQ ID NO: 832024 - DNA, 20 bp, mouse
gggagcccagaagccccggc

SEQ ID NO: 832025 - DNA, 20 bp, mouse
gcgacagccgcgcgcgtccc

SEQ ID NO: 832026 - DNA, 20 bp, mouse
gcagccgcgcgagagcccgt

SEQ ID NO: 832027 - DNA, 20 bp, mouse
gatgctcgccggtgtgtcgc

SEQ ID NO: 832028 - DNA, 20 bp, mouse
gcgcccccggctgctgaggt

SEQ ID NO: 832029 - DNA, 20 bp, mouse
gccggagctgaggtccccgt

SEQ ID NO: 832030 - DNA, 20 bp, mouse
gtggcatcgctcggtggctc

SEQ ID NO: 832031 - DNA, 20 bp, mouse
ggcggctgctgccacgtcgc

SEQ ID NO: 832032 - DNA, 20 bp, mouse
gccgcaatccggcccggcca

SEQ ID NO: 832033 - DNA, 20 bp, mouse
gaggtccccgtcggcgaagg

SEQ ID NO: 832034 - DNA, 20 bp, mouse
gcctccagaaagcctcggag

SEQ ID NO: 832035 - DNA, 20 bp, mouse
ggaccactggcatcgctcgg

SEQ ID NO: 832036 - DNA, 20 bp, mouse
ggaacctggaacccgactgt

SEQ ID NO: 832037 - DNA, 20 bp, mouse
gggaacccgactgtgggtgc

SEQ ID NO: 832038 - DNA, 20 bp, mouse
gccagagcgccgcgcttctc

SEQ ID NO: 832039 - DNA, 20 bp, mouse
gcatacccgtcagtccgctc

SEQ ID NO: 832040 - DNA, 20 bp, mouse
ggtgacagagggcagagaag

SEQ ID NO: 832041 - DNA, 20 bp, mouse
gtcacccagatcccggaacg

SEQ ID NO: 832042 - DNA, 20 bp, mouse
gggagcgccacggtggaacc

SEQ ID NO: 832043 - DNA, 20 bp, mouse
gaaaccgaagcgggcctcca

SEQ ID NO: 832044 - DNA, 20 bp, mouse
gggtgccggaagcgcgcagg

SEQ ID NO: 832045 - DNA, 20 bp, mouse
ggcggaagtcacccagatcc

SEQ ID NO: 832046 - DNA, 20 bp, mouse
gcgcaggccgcggggttgaa

SEQ ID NO: 832047 - DNA, 20 bp, mouse
gtgagcaagcagcacagcag

SEQ ID NO: 832048 - DNA, 20 bp, mouse
gcgcgccggcgccccacggc

SEQ ID NO: 832049 - DNA, 20 bp, mouse
ggcggggccgcaaccgtcgc

SEQ ID NO: 832050 - DNA, 20 bp, mouse
gcccgcgtcgggaggacttc

SEQ ID NO: 832051 - DNA, 20 bp, mouse
ggggcgggctggggtgacat

SEQ ID NO: 832052 - DNA, 20 bp, mouse
ggacggttgcggccccgcgt

SEQ ID NO: 832053 - DNA, 20 bp, mouse
gtgcgcgcgccggcgcccca

SEQ ID NO: 832054 - DNA, 20 bp, mouse
gccggggtggccggatgacg

SEQ ID NO: 832055 - DNA, 20 bp, mouse
gcagcacagcagcggcgact

SEQ ID NO: 832056 - DNA, 20 bp, mouse
gactaggtgaagagaacgta

SEQ ID NO: 832057 - DNA, 20 bp, mouse
gggtctgccagaagtcaata

SEQ ID NO: 832058 - DNA, 20 bp, mouse
gacgacaaaaacgcagtgta

SEQ ID NO: 832059 - DNA, 20 bp, mouse
gttggagccatattgacttc

SEQ ID NO: 832060 - DNA, 20 bp, mouse
gtgccaaggccaatctgcca

SEQ ID NO: 832061 - DNA, 20 bp, mouse
gcgggaccttaattgtgaaa

SEQ ID NO: 832062 - DNA, 20 bp, mouse
gagcggaagtggtgcttctg

SEQ ID NO: 832063 - DNA, 20 bp, mouse
ggcagaaagagtcgttgcca

SEQ ID NO: 832064 - DNA, 20 bp, mouse
ggaacgtacggtgtaactat

SEQ ID NO: 832065 - DNA, 20 bp, mouse
gatgcaaaaggagtaggcgg

SEQ ID NO: 832066 - DNA, 20 bp, mouse
gcagcccgggagccacacaa

SEQ ID NO: 832067 - DNA, 20 bp, mouse
gccagaaggcagctctccat

SEQ ID NO: 832068 - DNA, 20 bp, mouse
gcgggagccacacaaaggcg

SEQ ID NO: 832069 - DNA, 20 bp, mouse
gaaaggccggccttgagtat

SEQ ID NO: 832070 - DNA, 20 bp, mouse
ggaaacaaataggggcggac

SEQ ID NO: 832071 - DNA, 20 bp, mouse
gtactctccccgcctttgtg

SEQ ID NO: 832072 - DNA, 20 bp, mouse
gccgggctgtaaaacaaggc

SEQ ID NO: 832073 - DNA, 20 bp, mouse
gctgggagatgggcacctct

SEQ ID NO: 832074 - DNA, 20 bp, mouse
gcatgggcgagcaacttgtt

SEQ ID NO: 832075 - DNA, 20 bp, mouse
gaaatggtagagaaaatcaa

SEQ ID NO: 832076 - DNA, 20 bp, mouse
gcggtcaggggtcaattgag

SEQ ID NO: 832077 - DNA, 20 bp, mouse
gggcttaggcaattcaggta

SEQ ID NO: 832078 - DNA, 20 bp, mouse
gcaagtggcgggcacgagat

SEQ ID NO: 832079 - DNA, 20 bp, mouse
gaggcaattcaggtacgggg

SEQ ID NO: 832080 - DNA, 20 bp, mouse
ggcgggtgctgaccggtcag

SEQ ID NO: 832081 - DNA, 20 bp, mouse
gggtcagcacccgcccctga

SEQ ID NO: 832082 - DNA, 20 bp, mouse
gcaattgagtggcagacgcg

SEQ ID NO: 832083 - DNA, 20 bp, mouse
gcacgagatgggataggaga

SEQ ID NO: 832084 - DNA, 20 bp, mouse
gctttctgctggagcctaat

SEQ ID NO: 832085 - DNA, 20 bp, mouse
gaaaggatgccttcaggggc

SEQ ID NO: 832086 - DNA, 20 bp, mouse
gcggcaccccgagacctcca

SEQ ID NO: 832087 - DNA, 20 bp, mouse
gcacacctgggtcgtggttg

SEQ ID NO: 832088 - DNA, 20 bp, mouse
gagacctccagggagcgctg

SEQ ID NO: 832089 - DNA, 20 bp, mouse
gctgggtcgtggttgaggtc

SEQ ID NO: 832090 - DNA, 20 bp, mouse
ggaggtctcggggtgccggg

SEQ ID NO: 832091 - DNA, 20 bp, mouse
gaccacgacccaggtgtgag

SEQ ID NO: 832092 - DNA, 20 bp, mouse
ggggtggagtctggaattca

SEQ ID NO: 832093 - DNA, 20 bp, mouse
gggctcctccccactggcgg

SEQ ID NO: 832094 - DNA, 20 bp, mouse
gaggggaccccagcgctccc

SEQ ID NO: 832095 - DNA, 20 bp, mouse
ggcgcaaatcgctgatatgt

SEQ ID NO: 832096 - DNA, 20 bp, mouse
ggaaaagtctccactaggag

SEQ ID NO: 832097 - DNA, 20 bp, mouse
gctctcccacgtcatcgcaa

SEQ ID NO: 832098 - DNA, 20 bp, mouse
gaactcccttgcgatgacgt

SEQ ID NO: 832099 - DNA, 20 bp, mouse
gaggctggacagatgaacaa

SEQ ID NO: 832100 - DNA, 20 bp, mouse
gctagtggagacttttccat

SEQ ID NO: 832101 - DNA, 20 bp, mouse
gtggcggccatcccggaagt

SEQ ID NO: 832102 - DNA, 20 bp, mouse
ggaggaggttgctttctagt

SEQ ID NO: 832103 - DNA, 20 bp, mouse
gaaccagtcgatcgctccca

SEQ ID NO: 832104 - DNA, 20 bp, mouse
gaagcaacctcctctcctag

SEQ ID NO: 832105 - DNA, 20 bp, mouse
gtcgcaagggagttttttct

SEQ ID NO: 832106 - DNA, 20 bp, mouse
gcaaacccggagtgagggat

SEQ ID NO: 832107 - DNA, 20 bp, mouse
ggaggcctattgctaaggtg

SEQ ID NO: 832108 - DNA, 20 bp, mouse
gaagtgaaatggggcgtgtc

SEQ ID NO: 832109 - DNA, 20 bp, mouse
gccgctttcgtcagagtcat

SEQ ID NO: 832110 - DNA, 20 bp, mouse
ggagtaggaaaagtgaaatg

SEQ ID NO: 832111 - DNA, 20 bp, mouse
gtgagggcggggtttcccta

SEQ ID NO: 832112 - DNA, 20 bp, mouse
gtacgtgcgaaactaggatc

SEQ ID NO: 832113 - DNA, 20 bp, mouse
ggacaggagcagtgcagccg

SEQ ID NO: 832114 - DNA, 20 bp, mouse
gaggcggaggcctattgcta

SEQ ID NO: 832115 - DNA, 20 bp, mouse
gtgcccaggcgagttctcat

SEQ ID NO: 832116 - DNA, 20 bp, mouse
gtaggctgaatatggcatat

SEQ ID NO: 832117 - DNA, 20 bp, mouse
gaatgaagcaatcaggtcaa

SEQ ID NO: 832118 - DNA, 20 bp, mouse
gttgagtataaggtacaaat

SEQ ID NO: 832119 - DNA, 20 bp, mouse
gtgtaccttatactcaaaat

SEQ ID NO: 832120 - DNA, 20 bp, mouse
ggccctcactatatgtaatt

SEQ ID NO: 832121 - DNA, 20 bp, mouse
gcagccttgacctggagttc

SEQ ID NO: 832122 - DNA, 20 bp, mouse
gtgacctggagttcaggtgt

SEQ ID NO: 832123 - DNA, 20 bp, mouse
gtaagatgtaggactttata

SEQ ID NO: 832124 - DNA, 20 bp, mouse
gtgtcagttcactcttagaa

SEQ ID NO: 832125 - DNA, 20 bp, mouse
gacgcccacacctgaactcc

SEQ ID NO: 832126 - DNA, 20 bp, mouse
gaaggtgtgagctatgtcgc

SEQ ID NO: 832127 - DNA, 20 bp, mouse
gtatacatgagggccctaga

SEQ ID NO: 832128 - DNA, 20 bp, mouse
gaccacaggcatgccagcca

SEQ ID NO: 832129 - DNA, 20 bp, mouse
gcaggcatgccagccaggga

SEQ ID NO: 832130 - DNA, 20 bp, mouse
gaatcagggactcaagacac

SEQ ID NO: 832131 - DNA, 20 bp, mouse
gggcagggaaacccgagcgg

SEQ ID NO: 832132 - DNA, 20 bp, mouse
gcttggcagggaaacccgag

SEQ ID NO: 832133 - DNA, 20 bp, mouse
gtatacctttgagtccaatc

SEQ ID NO: 832134 - DNA, 20 bp, mouse
gctcctgataatgataccac

SEQ ID NO: 832135 - DNA, 20 bp, mouse
gtgcctgtggtatcattatc

SEQ ID NO: 832136 - DNA, 20 bp, mouse
gggcgtggcccagtagccta

SEQ ID NO: 832137 - DNA, 20 bp, mouse
gctaagatcgggacagttgg

SEQ ID NO: 832138 - DNA, 20 bp, mouse
gtggctaagatcgggacagt

SEQ ID NO: 832139 - DNA, 20 bp, mouse
gaatctcttgtgcccagaca

SEQ ID NO: 832140 - DNA, 20 bp, mouse
gggcagttgctaaacacttt

SEQ ID NO: 832141 - DNA, 20 bp, mouse
ggtagcagggaaaacatggg

SEQ ID NO: 832142 - DNA, 20 bp, mouse
gaacactttaggagcatagg

SEQ ID NO: 832143 - DNA, 20 bp, mouse
gcagctgtagtcagatgtag

SEQ ID NO: 832144 - DNA, 20 bp, mouse
gcagtagcctagggctgtct

SEQ ID NO: 832145 - DNA, 20 bp, mouse
ggctgtctctaagtctcttc

SEQ ID NO: 832146 - DNA, 20 bp, mouse
gagtcacccgggtcacctag

SEQ ID NO: 832147 - DNA, 20 bp, mouse
gtgtaaggacttcaattccc

SEQ ID NO: 832148 - DNA, 20 bp, mouse
gcctgagcggccaaacttca

SEQ ID NO: 832149 - DNA, 20 bp, mouse
gcggggactgccctcggtaa

SEQ ID NO: 832150 - DNA, 20 bp, mouse
ggggagcccagaaatggctc

SEQ ID NO: 832151 - DNA, 20 bp, mouse
gcattctgggtcagtgtctt

SEQ ID NO: 832152 - DNA, 20 bp, mouse
gacctggccactaggtgacc

SEQ ID NO: 832153 - DNA, 20 bp, mouse
gggactgccctcggtaaggg

SEQ ID NO: 832154 - DNA, 20 bp, mouse
ggtaagagcaagctcccctg

SEQ ID NO: 832155 - DNA, 20 bp, mouse
ggtctggctgccatgaagtt

SEQ ID NO: 832156 - DNA, 20 bp, mouse
ggacctgtaaccacaggaca

SEQ ID NO: 832157 - DNA, 20 bp, mouse
gtcaaggaaaactttgagga

SEQ ID NO: 832158 - DNA, 20 bp, mouse
ggttctagaaacagaaggtg

SEQ ID NO: 832159 - DNA, 20 bp, mouse
gtccactatgtcactatgtg

SEQ ID NO: 832160 - DNA, 20 bp, mouse
ggaagaggatagatatcaga

SEQ ID NO: 832161 - DNA, 20 bp, mouse
gcatttgatatgtatatctc

SEQ ID NO: 832162 - DNA, 20 bp, mouse
ggtatatctcagggacagtg

SEQ ID NO: 832163 - DNA, 20 bp, mouse
gccccattgtctttaatgga

SEQ ID NO: 832164 - DNA, 20 bp, mouse
gccaaaaagtgcattctcat

SEQ ID NO: 832165 - DNA, 20 bp, mouse
gcccccacatagtgacatag

SEQ ID NO: 832166 - DNA, 20 bp, mouse
gatcccgcgtgggaaggcta

SEQ ID NO: 832167 - DNA, 20 bp, mouse
gagacttgagggtggagtgc

SEQ ID NO: 832168 - DNA, 20 bp, mouse
gacagggcactgttttggat

SEQ ID NO: 832169 - DNA, 20 bp, mouse
ggggactggtaagtgacccc

SEQ ID NO: 832170 - DNA, 20 bp, mouse
ggcgtgggaaggctagggac

SEQ ID NO: 832171 - DNA, 20 bp, mouse
gcctcaagtctgagtaaagt

SEQ ID NO: 832172 - DNA, 20 bp, mouse
gaccacgcccagggcggagc

SEQ ID NO: 832173 - DNA, 20 bp, mouse
gaacagttaaccaggctggg

SEQ ID NO: 832174 - DNA, 20 bp, mouse
ggggcccggtgccacgtggg

SEQ ID NO: 832175 - DNA, 20 bp, mouse
ggacggcatttccacgtccc

SEQ ID NO: 832176 - DNA, 20 bp, mouse
ggcaccgagagagtaggaaa

SEQ ID NO: 832177 - DNA, 20 bp, mouse
gtctcagagtaccagaagag

SEQ ID NO: 832178 - DNA, 20 bp, mouse
gcgggcggggccgttcccac

SEQ ID NO: 832179 - DNA, 20 bp, mouse
gaagactgagaggctcctgg

SEQ ID NO: 832180 - DNA, 20 bp, mouse
ggtggggaccggctacctcc

SEQ ID NO: 832181 - DNA, 20 bp, mouse
gtgtcacttggtagcaagtg

SEQ ID NO: 832182 - DNA, 20 bp, mouse
gggtactctgagacccaggt

SEQ ID NO: 832183 - DNA, 20 bp, mouse
gtgtgtagatggctgtctag

SEQ ID NO: 832184 - DNA, 20 bp, mouse
ggccggcggccctgccttgt

SEQ ID NO: 832185 - DNA, 20 bp, mouse
gacacacacacgaacccaaa

SEQ ID NO: 832186 - DNA, 20 bp, mouse
ggaagtgcacgcagaggcag

SEQ ID NO: 832187 - DNA, 20 bp, mouse
ggggctggcggccaggaagg

SEQ ID NO: 832188 - DNA, 20 bp, mouse
gtcccgacctggagggtcac

SEQ ID NO: 832189 - DNA, 20 bp, mouse
gcagagagcaggctagtgat

SEQ ID NO: 832190 - DNA, 20 bp, mouse
gggtcacgggcacaggtgag

SEQ ID NO: 832191 - DNA, 20 bp, mouse
gggtcgggaagtgcacgcag

SEQ ID NO: 832192 - DNA, 20 bp, mouse
gtgcccgtgaccctccaggt

SEQ ID NO: 832193 - DNA, 20 bp, mouse
gcgcaccaggacacgcctaa

SEQ ID NO: 832194 - DNA, 20 bp, mouse
ggagaggcgcgggtggcacc

SEQ ID NO: 832195 - DNA, 20 bp, mouse
ggtgcggggacccttatctg

SEQ ID NO: 832196 - DNA, 20 bp, mouse
gcgggcgcaggtcaagtaag

SEQ ID NO: 832197 - DNA, 20 bp, mouse
gcgggaccgcgcacgccgtg

SEQ ID NO: 832198 - DNA, 20 bp, mouse
gcgacagcgcatgcgcaagg

SEQ ID NO: 832199 - DNA, 20 bp, mouse
gggggcgtgacccgacccag

SEQ ID NO: 832200 - DNA, 20 bp, mouse
ggggtcgggtcacgccccca

SEQ ID NO: 832201 - DNA, 20 bp, mouse
ggaagagcccacggtccgag

SEQ ID NO: 832202 - DNA, 20 bp, mouse
gtgacctgcgcccgcgtggg

SEQ ID NO: 832203 - DNA, 20 bp, mouse
ggatacgtggggtccagagg

SEQ ID NO: 832204 - DNA, 20 bp, mouse
gcgtggctacacctctgggt

SEQ ID NO: 832205 - DNA, 20 bp, mouse
gtggaaggccctgggagtca

SEQ ID NO: 832206 - DNA, 20 bp, mouse
gaatcccccacccaggatct

SEQ ID NO: 832207 - DNA, 20 bp, mouse
gtggctgcaaaccttggcac

SEQ ID NO: 832208 - DNA, 20 bp, mouse
gtggagccatctctgaccta

SEQ ID NO: 832209 - DNA, 20 bp, mouse
ggggagttatttatggaagt

SEQ ID NO: 832210 - DNA, 20 bp, mouse
gtcagagatggctccagaca

SEQ ID NO: 832211 - DNA, 20 bp, mouse
gttggaaccttcttgaactt

SEQ ID NO: 832212 - DNA, 20 bp, mouse
gtaaatactgagggccaatg

SEQ ID NO: 832213 - DNA, 20 bp, mouse
gggctcctagagatagcact

SEQ ID NO: 832214 - DNA, 20 bp, mouse
gaggctccataggtcagaga

SEQ ID NO: 832215 - DNA, 20 bp, mouse
gatgtgtcagctgatgactt

SEQ ID NO: 832216 - DNA, 20 bp, mouse
ggagaggcgtgggagcgcgt

SEQ ID NO: 832217 - DNA, 20 bp, mouse
ggcgcgtgggccccgttcgc

SEQ ID NO: 832218 - DNA, 20 bp, mouse
gtgggccccgttcgcaggca

SEQ ID NO: 832219 - DNA, 20 bp, mouse
gcggcgcctagacccgctcc

SEQ ID NO: 832220 - DNA, 20 bp, mouse
gccccgttcgcaggcaggga

SEQ ID NO: 832221 - DNA, 20 bp, mouse
gtgagcccggcacctggagc

SEQ ID NO: 832222 - DNA, 20 bp, mouse
gtctgagccgggagaggcgt

SEQ ID NO: 832223 - DNA, 20 bp, mouse
ggccctccctgcctgcgaac

SEQ ID NO: 832224 - DNA, 20 bp, mouse
ggctccgtggaatactagat

SEQ ID NO: 832225 - DNA, 20 bp, mouse
gtgagcacacaggaggttgc

SEQ ID NO: 832226 - DNA, 20 bp, mouse
gggaaagccaggtcggtcgg

SEQ ID NO: 832227 - DNA, 20 bp, mouse
gggcaacgcgcaagtctcgg

SEQ ID NO: 832228 - DNA, 20 bp, mouse
gcgccatagtcgggagagag

SEQ ID NO: 832229 - DNA, 20 bp, mouse
gcaggtcggtcggaggatgg

SEQ ID NO: 832230 - DNA, 20 bp, mouse
gcgggcctggcgcgcgcctt

SEQ ID NO: 832231 - DNA, 20 bp, mouse
gtgccgctctctcccgacta

SEQ ID NO: 832232 - DNA, 20 bp, mouse
gaacggtggcgcagtcgaag

SEQ ID NO: 832233 - DNA, 20 bp, mouse
gctagtgtgaggtaggcgat

SEQ ID NO: 832234 - DNA, 20 bp, mouse
gcggtcggaggatggcggtg

SEQ ID NO: 832235 - DNA, 20 bp, mouse
ggaagcggaagtgtagactc

SEQ ID NO: 832236 - DNA, 20 bp, mouse
gctagaagtggggacagctt

SEQ ID NO: 832237 - DNA, 20 bp, mouse
gctcaagagcaaggaggtac

SEQ ID NO: 832238 - DNA, 20 bp, mouse
gcatttctgtcattgtagga

SEQ ID NO: 832239 - DNA, 20 bp, mouse
ggctgtgccagaaccaagac

SEQ ID NO: 832240 - DNA, 20 bp, mouse
gtccccacttctagtgatat

SEQ ID NO: 832241 - DNA, 20 bp, mouse
gagtggggacagcttgggcc

SEQ ID NO: 832242 - DNA, 20 bp, mouse
gctctggccagtcttggttc

SEQ ID NO: 832243 - DNA, 20 bp, mouse
gcacaaagcacggctcataa

SEQ ID NO: 832244 - DNA, 20 bp, mouse
gttggttgctgtatcagact

SEQ ID NO: 832245 - DNA, 20 bp, mouse
gaccaatatcactagaagtg

SEQ ID NO: 832246 - DNA, 20 bp, mouse
gagcccccccagtcacctga

SEQ ID NO: 832247 - DNA, 20 bp, mouse
gcgcctgcgcagaggaagag

SEQ ID NO: 832248 - DNA, 20 bp, mouse
gggggggctcgctccgtctt

SEQ ID NO: 832249 - DNA, 20 bp, mouse
gcgtgcccgtcgtggtgttg

SEQ ID NO: 832250 - DNA, 20 bp, mouse
gcctccccggagatccaact

SEQ ID NO: 832251 - DNA, 20 bp, mouse
gccgtcgtggtgttgaggga

SEQ ID NO: 832252 - DNA, 20 bp, mouse
gagctccgaggcacagcgtt

SEQ ID NO: 832253 - DNA, 20 bp, mouse
gaggccgggcgtgcccgtcg

SEQ ID NO: 832254 - DNA, 20 bp, mouse
ggagcccagttggatctccg

SEQ ID NO: 832255 - DNA, 20 bp, mouse
gcgcggaggtcacctctctg

SEQ ID NO: 832256 - DNA, 20 bp, mouse
gagtgggtggctagtctaac

SEQ ID NO: 832257 - DNA, 20 bp, mouse
gaaccttgctggcacgtagt

SEQ ID NO: 832258 - DNA, 20 bp, mouse
gaaaacggaggcccgtggga

SEQ ID NO: 832259 - DNA, 20 bp, mouse
gaccccaagaatggaagggg

SEQ ID NO: 832260 - DNA, 20 bp, mouse
gccgtgggacggaagagcca

SEQ ID NO: 832261 - DNA, 20 bp, mouse
ggagccacgggtgcaacgac

SEQ ID NO: 832262 - DNA, 20 bp, mouse
gagagcggaggatgaggcat

SEQ ID NO: 832263 - DNA, 20 bp, mouse
gggctcccaaatgaggagag

SEQ ID NO: 832264 - DNA, 20 bp, mouse
gtcccaaatgaggagagcgg

SEQ ID NO: 832265 - DNA, 20 bp, mouse
ggtggctagtctaacaggaa

SEQ ID NO: 832266 - DNA, 20 bp, mouse
gggcaagcagcatgtcaccg

SEQ ID NO: 832267 - DNA, 20 bp, mouse
gccagtgttagaacttctgt

SEQ ID NO: 832268 - DNA, 20 bp, mouse
gtaagcatggacatacttca

SEQ ID NO: 832269 - DNA, 20 bp, mouse
ggaaggttgtgagattctat

SEQ ID NO: 832270 - DNA, 20 bp, mouse
ggcccaagtgggatgaagat

SEQ ID NO: 832271 - DNA, 20 bp, mouse
gctaacactggaaagataac

SEQ ID NO: 832272 - DNA, 20 bp, mouse
gggatgaatgggttgttagt

SEQ ID NO: 832273 - DNA, 20 bp, mouse
gggacatacttcagggagtc

SEQ ID NO: 832274 - DNA, 20 bp, mouse
ggcacatggtggcatcactg

SEQ ID NO: 832275 - DNA, 20 bp, mouse
gggagtcataaccctatgga

SEQ ID NO: 832276 - DNA, 20 bp, mouse
gtggggcagcatgtcatagt

SEQ ID NO: 832277 - DNA, 20 bp, mouse
ggcaacagctatctgctcta

SEQ ID NO: 832278 - DNA, 20 bp, mouse
gtgggagagtccaaagcttc

SEQ ID NO: 832279 - DNA, 20 bp, mouse
gctaacctgccctgaagctt

SEQ ID NO: 832280 - DNA, 20 bp, mouse
gacagctaaaacatcatctg

SEQ ID NO: 832281 - DNA, 20 bp, mouse
ggagtccaaagcttcagggc

SEQ ID NO: 832282 - DNA, 20 bp, mouse
gactctcccactttgctact

SEQ ID NO: 832283 - DNA, 20 bp, mouse
ggtcatcccagtagcaaagt

SEQ ID NO: 832284 - DNA, 20 bp, mouse
ggttaggtgtcttatgaaac

SEQ ID NO: 832285 - DNA, 20 bp, mouse
gtgtgcccgaattgttctaa

SEQ ID NO: 832286 - DNA, 20 bp, mouse
gagagcgggcgatggtgcga

SEQ ID NO: 832287 - DNA, 20 bp, mouse
gtgagcgtgcgcttgttgag

SEQ ID NO: 832288 - DNA, 20 bp, mouse
gcggggcggtgacgcaagag

SEQ ID NO: 832289 - DNA, 20 bp, mouse
gcgcaacaggggtgaaggat

SEQ ID NO: 832290 - DNA, 20 bp, mouse
gtgacagcgcaggcctgggg

SEQ ID NO: 832291 - DNA, 20 bp, mouse
gctgcccgcaacaggggtga

SEQ ID NO: 832292 - DNA, 20 bp, mouse
ggagtggatggtgacagcgc

SEQ ID NO: 832293 - DNA, 20 bp, mouse
gcgtgcgcttgttgagtgga

SEQ ID NO: 832294 - DNA, 20 bp, mouse
ggtgacgcaagagcgggcga

SEQ ID NO: 832295 - DNA, 20 bp, mouse
gaaggatggggcttgcgtga

SEQ ID NO: 832296 - DNA, 20 bp, mouse
ggactgaagggccccaggat

SEQ ID NO: 832297 - DNA, 20 bp, mouse
gccgcggaatgctgactgaa

SEQ ID NO: 832298 - DNA, 20 bp, mouse
ggtgcccccaccaaatgcag

SEQ ID NO: 832299 - DNA, 20 bp, mouse
gagagagcgggcggtgccaa

SEQ ID NO: 832300 - DNA, 20 bp, mouse
gtcaaccactgcatttggtg

SEQ ID NO: 832301 - DNA, 20 bp, mouse
gcagtggttgatatcagact

SEQ ID NO: 832302 - DNA, 20 bp, mouse
gctgttcgaccccaaagccg

SEQ ID NO: 832303 - DNA, 20 bp, mouse
gccagggcagctccccatcc

SEQ ID NO: 832304 - DNA, 20 bp, mouse
gcggcaaagctcattggctt

SEQ ID NO: 832305 - DNA, 20 bp, mouse
gactaaacggggaggtttgc

SEQ ID NO: 832306 - DNA, 20 bp, mouse
gaggctgcccatacttacta

SEQ ID NO: 832307 - DNA, 20 bp, mouse
gcaccagctgcgtagactcg

SEQ ID NO: 832308 - DNA, 20 bp, mouse
gtcagcgggtgaatgtggat

SEQ ID NO: 832309 - DNA, 20 bp, mouse
gggcgcggacggcctcgcca

SEQ ID NO: 832310 - DNA, 20 bp, mouse
ggacagtggagcactgaaga

SEQ ID NO: 832311 - DNA, 20 bp, mouse
gctaagaggaagcaaagatt

SEQ ID NO: 832312 - DNA, 20 bp, mouse
gagggcagaggcgcgtcacg

SEQ ID NO: 832313 - DNA, 20 bp, mouse
gagtctacgcagctggtggg

SEQ ID NO: 832314 - DNA, 20 bp, mouse
gcgtgtacgaaaaactcctg

SEQ ID NO: 832315 - DNA, 20 bp, mouse
ggagtgagccatagtaagta

SEQ ID NO: 832316 - DNA, 20 bp, mouse
gaagaagtcttcattatctc

SEQ ID NO: 832317 - DNA, 20 bp, mouse
gtattgcccgggcattcagt

SEQ ID NO: 832318 - DNA, 20 bp, mouse
gagagtgatagttattgccc

SEQ ID NO: 832319 - DNA, 20 bp, mouse
gcacgctgccatgtacagta

SEQ ID NO: 832320 - DNA, 20 bp, mouse
gttcctccaactgaatgccc

SEQ ID NO: 832321 - DNA, 20 bp, mouse
gtcattaaacttatctgcct

SEQ ID NO: 832322 - DNA, 20 bp, mouse
gaggattaccgtactgtaca

SEQ ID NO: 832323 - DNA, 20 bp, mouse
gtcttgtgagtcaaagattg

SEQ ID NO: 832324 - DNA, 20 bp, mouse
gaagaaaccacttagatttt

SEQ ID NO: 832325 - DNA, 20 bp, mouse
gtgcccgggcattcagttgg

SEQ ID NO: 832326 - DNA, 20 bp, mouse
gcggccgcggagggacaagg

SEQ ID NO: 832327 - DNA, 20 bp, mouse
gcactcaagcccttcgacgt

SEQ ID NO: 832328 - DNA, 20 bp, mouse
gccggcggcgcctcccaagg

SEQ ID NO: 832329 - DNA, 20 bp, mouse
gacaaggcggatgctgaggt

SEQ ID NO: 832330 - DNA, 20 bp, mouse
ggatcattggcccacgtcga

SEQ ID NO: 832331 - DNA, 20 bp, mouse
gggatgctgaggttggacag

SEQ ID NO: 832332 - DNA, 20 bp, mouse
gcggcggccgcggagggaca

SEQ ID NO: 832333 - DNA, 20 bp, mouse
gtggactaggagcggcgaaa

SEQ ID NO: 832334 - DNA, 20 bp, mouse
gtcagctccgccccttccgg

SEQ ID NO: 832335 - DNA, 20 bp, mouse
gacgtggcagccgtcggccc

SEQ ID NO: 832336 - DNA, 20 bp, mouse
gagccgcacaccagagaggt

SEQ ID NO: 832337 - DNA, 20 bp, mouse
gcaagcgcatcactgagttt

SEQ ID NO: 832338 - DNA, 20 bp, mouse
ggcgcagccgcacaccagag

SEQ ID NO: 832339 - DNA, 20 bp, mouse
gggttccccgcccacctctc

SEQ ID NO: 832340 - DNA, 20 bp, mouse
gtcagcacagcggttccggg

SEQ ID NO: 832341 - DNA, 20 bp, mouse
gtcagtgcgtcccttcaact

SEQ ID NO: 832342 - DNA, 20 bp, mouse
gagtagttaggaggactcga

SEQ ID NO: 832343 - DNA, 20 bp, mouse
gcagtgatgcgcttgcgcag

SEQ ID NO: 832344 - DNA, 20 bp, mouse
gttcaccttaggtaggaggg

SEQ ID NO: 832345 - DNA, 20 bp, mouse
gttagtgtctgccacgtctc

SEQ ID NO: 832346 - DNA, 20 bp, mouse
gagggactgcgacactgcgc

SEQ ID NO: 832347 - DNA, 20 bp, mouse
gacaatgcaagcttggggtc

SEQ ID NO: 832348 - DNA, 20 bp, mouse
ggtcgggtgtacagcggacc

SEQ ID NO: 832349 - DNA, 20 bp, mouse
gggtgctaggcgacttgaga

SEQ ID NO: 832350 - DNA, 20 bp, mouse
ggcttctgtcccttgtcttt

SEQ ID NO: 832351 - DNA, 20 bp, mouse
gagcggaccgggtttcgaaa

SEQ ID NO: 832352 - DNA, 20 bp, mouse
gtttacgctaggggacgctc

SEQ ID NO: 832353 - DNA, 20 bp, mouse
gcggcccaatgaagctgccc

SEQ ID NO: 832354 - DNA, 20 bp, mouse
ggtaaggctagtttacgcta

SEQ ID NO: 832355 - DNA, 20 bp, mouse
ggagaagcaagcgtactttt

SEQ ID NO: 832356 - DNA, 20 bp, mouse
gcccgggaggcgggtcccaa

SEQ ID NO: 832357 - DNA, 20 bp, mouse
gtcgcagagccccgcgtggt

SEQ ID NO: 832358 - DNA, 20 bp, mouse
gcacgcggggctctgcgaac

SEQ ID NO: 832359 - DNA, 20 bp, mouse
gcgaacgggagcggggcgca

SEQ ID NO: 832360 - DNA, 20 bp, mouse
gtacccccgccaacgttgat

SEQ ID NO: 832361 - DNA, 20 bp, mouse
ggcatgccgggaaatgagtc

SEQ ID NO: 832362 - DNA, 20 bp, mouse
gcgacgggaaatgtagtccg

SEQ ID NO: 832363 - DNA, 20 bp, mouse
gacaagtctggtgtgaagga

SEQ ID NO: 832364 - DNA, 20 bp, mouse
gcggcgtgccgtggtcacct

SEQ ID NO: 832365 - DNA, 20 bp, mouse
gggggctctgcgaacgggag

SEQ ID NO: 832366 - DNA, 20 bp, mouse
gagaccctgcactgcaccaa

SEQ ID NO: 832367 - DNA, 20 bp, mouse
gcactgcaccaacggagggg

SEQ ID NO: 832368 - DNA, 20 bp, mouse
gcctccgttggtgcagtgca

SEQ ID NO: 832369 - DNA, 20 bp, mouse
gaagaacagtgtggttacat

SEQ ID NO: 832370 - DNA, 20 bp, mouse
gctgaaactggtcctaagtg

SEQ ID NO: 832371 - DNA, 20 bp, mouse
gggtcctaagtgtggcgtgt

SEQ ID NO: 832372 - DNA, 20 bp, mouse
gtgctcacaatcccgtggaa

SEQ ID NO: 832373 - DNA, 20 bp, mouse
gtgtagatcttctgtaatac

SEQ ID NO: 832374 - DNA, 20 bp, mouse
ggctgggaattgaacccaca

SEQ ID NO: 832375 - DNA, 20 bp, mouse
gtctacaatggctctgaaac

SEQ ID NO: 832376 - DNA, 20 bp, mouse
ggaagcgcgtgaggcctccg

SEQ ID NO: 832377 - DNA, 20 bp, mouse
ggacccggatgtggtatctg

SEQ ID NO: 832378 - DNA, 20 bp, mouse
gggcggcgctcctggggcga

SEQ ID NO: 832379 - DNA, 20 bp, mouse
gaggcgatgcagtgaggacg

SEQ ID NO: 832380 - DNA, 20 bp, mouse
gaaggcgaggcgatgcagtg

SEQ ID NO: 832381 - DNA, 20 bp, mouse
ggccagtgccgggaagtcga

SEQ ID NO: 832382 - DNA, 20 bp, mouse
ggagcgccgcccacgcaccg

SEQ ID NO: 832383 - DNA, 20 bp, mouse
gtgcgtgggcggcgctcctg

SEQ ID NO: 832384 - DNA, 20 bp, mouse
gtgaggcctccgcggtgcgt

SEQ ID NO: 832385 - DNA, 20 bp, mouse
gcgccgcccacgcaccgcgg

SEQ ID NO: 832386 - DNA, 20 bp, mouse
gctggcctgacacgtgagag

SEQ ID NO: 832387 - DNA, 20 bp, mouse
gagccacgggccggaaggag

SEQ ID NO: 832388 - DNA, 20 bp, mouse
ggagacgctgtcggaagttg

SEQ ID NO: 832389 - DNA, 20 bp, mouse
ggggcggcagagggtagcgc

SEQ ID NO: 832390 - DNA, 20 bp, mouse
ggccggaaggagcggctggg

SEQ ID NO: 832391 - DNA, 20 bp, mouse
ggaaggatcgacaaaatctc

SEQ ID NO: 832392 - DNA, 20 bp, mouse
ggcctgacacgtgagagggg

SEQ ID NO: 832393 - DNA, 20 bp, mouse
gcccgcccctctcacgtgtc

SEQ ID NO: 832394 - DNA, 20 bp, mouse
gacttccgacagcgtctcta

SEQ ID NO: 832395 - DNA, 20 bp, mouse
ggggggggggcgtgcttttt

SEQ ID NO: 832396 - DNA, 20 bp, mouse
gcggaggcgtggtgtatcta

SEQ ID NO: 832397 - DNA, 20 bp, mouse
ggagccacgtagcccagcgg

SEQ ID NO: 832398 - DNA, 20 bp, mouse
ggcgcggcagtacctgattg

SEQ ID NO: 832399 - DNA, 20 bp, mouse
ggatacaccacgcctccgcg

SEQ ID NO: 832400 - DNA, 20 bp, mouse
gagcctgcgcaacatataag

SEQ ID NO: 832401 - DNA, 20 bp, mouse
gggcagtacctgattggggc

SEQ ID NO: 832402 - DNA, 20 bp, mouse
ggggagagttgtattactat

SEQ ID NO: 832403 - DNA, 20 bp, mouse
gggccaccgcagtgcctgcc

SEQ ID NO: 832404 - DNA, 20 bp, mouse
ggccgagccacgtagcccag

SEQ ID NO: 832405 - DNA, 20 bp, mouse
gtagggacttgtagtccatg

SEQ ID NO: 832406 - DNA, 20 bp, mouse
gccggggtcgccgatccctc

SEQ ID NO: 832407 - DNA, 20 bp, mouse
gcgtgggaaaggctcacaaa

SEQ ID NO: 832408 - DNA, 20 bp, mouse
gaacaatggctccccgggag

SEQ ID NO: 832409 - DNA, 20 bp, mouse
gaagctctctccagtatcct

SEQ ID NO: 832410 - DNA, 20 bp, mouse
gaccccggcccgcccggtga

SEQ ID NO: 832411 - DNA, 20 bp, mouse
gactggagagagcttcggga

SEQ ID NO: 832412 - DNA, 20 bp, mouse
gatccctccggctggccgga

SEQ ID NO: 832413 - DNA, 20 bp, mouse
gacggagccgcgggcgggga

SEQ ID NO: 832414 - DNA, 20 bp, mouse
gggagccattgttcctgagg

SEQ ID NO: 832415 - DNA, 20 bp, mouse
gcccgccccgcgcacacccc

SEQ ID NO: 832416 - DNA, 20 bp, mouse
gtaacccgagtgggtctagg

SEQ ID NO: 832417 - DNA, 20 bp, mouse
ggggagaagctcaggcttca

SEQ ID NO: 832418 - DNA, 20 bp, mouse
gcaagtgggagaaagaacgt

SEQ ID NO: 832419 - DNA, 20 bp, mouse
gagcccgcccggggtcacgt

SEQ ID NO: 832420 - DNA, 20 bp, mouse
gtcggtgaggaggtgcaagg

SEQ ID NO: 832421 - DNA, 20 bp, mouse
gcgcgatgcaggtcccggga

SEQ ID NO: 832422 - DNA, 20 bp, mouse
gatcccgcctagacccactc

SEQ ID NO: 832423 - DNA, 20 bp, mouse
gagcccatctgtggcatcag

SEQ ID NO: 832424 - DNA, 20 bp, mouse
gtctaggcgggatggctcct

SEQ ID NO: 832425 - DNA, 20 bp, mouse
gtagagaactagcccatctg

SEQ ID NO: 832426 - DNA, 20 bp, mouse
ggcaagccattggagaattc

SEQ ID NO: 832427 - DNA, 20 bp, mouse
gccattggagaattccggaa

SEQ ID NO: 832428 - DNA, 20 bp, mouse
ggaattccggaaaggagagt

SEQ ID NO: 832429 - DNA, 20 bp, mouse
ggctgtatgtagtgcctggg

SEQ ID NO: 832430 - DNA, 20 bp, mouse
gcggtcttctacattagcgg

SEQ ID NO: 832431 - DNA, 20 bp, mouse
gaaggctgtatgtagtgcct

SEQ ID NO: 832432 - DNA, 20 bp, mouse
gagggagggtccgcagtgga

SEQ ID NO: 832433 - DNA, 20 bp, mouse
gatagatagcggcgcactga

SEQ ID NO: 832434 - DNA, 20 bp, mouse
gcctccctccccctaagcaa

SEQ ID NO: 832435 - DNA, 20 bp, mouse
gtcacataaggaacactcat

SEQ ID NO: 832436 - DNA, 20 bp, mouse
gcagcagcggggaatgatac

SEQ ID NO: 832437 - DNA, 20 bp, mouse
gttgctccctagttccgggt

SEQ ID NO: 832438 - DNA, 20 bp, mouse
gggtctcccggacccggctg

SEQ ID NO: 832439 - DNA, 20 bp, mouse
ggctcttgctccctagttcc

SEQ ID NO: 832440 - DNA, 20 bp, mouse
ggctgctggtctcccggacc

SEQ ID NO: 832441 - DNA, 20 bp, mouse
gtttttcccacccggaacta

SEQ ID NO: 832442 - DNA, 20 bp, mouse
ggtttacaaccgtctttaaa

SEQ ID NO: 832443 - DNA, 20 bp, mouse
ggttctgttttcacgtacac

SEQ ID NO: 832444 - DNA, 20 bp, mouse
gtcatggggagcgttcagaa

SEQ ID NO: 832445 - DNA, 20 bp, mouse
ggggaaaaatgtgttctaga

SEQ ID NO: 832446 - DNA, 20 bp, mouse
gcaccgctgcacctgtatcg

SEQ ID NO: 832447 - DNA, 20 bp, mouse
ggaaggggtagcttcaaagg

SEQ ID NO: 832448 - DNA, 20 bp, mouse
gagggtaacaacatctcagc

SEQ ID NO: 832449 - DNA, 20 bp, mouse
gaacatctcagcagggtgag

SEQ ID NO: 832450 - DNA, 20 bp, mouse
gaacgaactctcacaggagg

SEQ ID NO: 832451 - DNA, 20 bp, mouse
gtactttgaaacaacggaaa

SEQ ID NO: 832452 - DNA, 20 bp, mouse
gttccacgatacaggtgcag

SEQ ID NO: 832453 - DNA, 20 bp, mouse
gaacaacggaaagggtgtgt

SEQ ID NO: 832454 - DNA, 20 bp, mouse
gtgactgaacgaactctcac

SEQ ID NO: 832455 - DNA, 20 bp, mouse
gacaggaggcggaaccagtc

SEQ ID NO: 832456 - DNA, 20 bp, mouse
ggggacgccttcctcggcag

SEQ ID NO: 832457 - DNA, 20 bp, mouse
gcgggggcggggccgggatt

SEQ ID NO: 832458 - DNA, 20 bp, mouse
ggccgtctgcctggcggaag

SEQ ID NO: 832459 - DNA, 20 bp, mouse
gcacgcgctcgcttggacgg

SEQ ID NO: 832460 - DNA, 20 bp, mouse
gaggggcgcagtgcgttgat

SEQ ID NO: 832461 - DNA, 20 bp, mouse
gccaagcgagcgcgtgggga

SEQ ID NO: 832462 - DNA, 20 bp, mouse
gtttccgcatgcgcgtagag

SEQ ID NO: 832463 - DNA, 20 bp, mouse
gacgctgacgcctgtcgttg

SEQ ID NO: 832464 - DNA, 20 bp, mouse
gggaaggcgtccccaacgac

SEQ ID NO: 832465 - DNA, 20 bp, mouse
gtcacccaggggccaagttc

SEQ ID NO: 832466 - DNA, 20 bp, mouse
gccggctctgcgagtctcac

SEQ ID NO: 832467 - DNA, 20 bp, mouse
gtggagggacctgtccatct

SEQ ID NO: 832468 - DNA, 20 bp, mouse
gccccatgatgtgagaaatt

SEQ ID NO: 832469 - DNA, 20 bp, mouse
gtgtcttccagtggcctctc

SEQ ID NO: 832470 - DNA, 20 bp, mouse
ggccaggaccaaactagttc

SEQ ID NO: 832471 - DNA, 20 bp, mouse
gaaactggacctagatggac

SEQ ID NO: 832472 - DNA, 20 bp, mouse
gagccggaagtgtcttccag

SEQ ID NO: 832473 - DNA, 20 bp, mouse
gtctcctcctgagaggccac

SEQ ID NO: 832474 - DNA, 20 bp, mouse
gacctgaactagtttggtcc

SEQ ID NO: 832475 - DNA, 20 bp, mouse
gtgcctctaccccaaacccc

SEQ ID NO: 832476 - DNA, 20 bp, mouse
gtacgcatgcgcactgtcac

SEQ ID NO: 832477 - DNA, 20 bp, mouse
gggaaggaggggctaggccc

SEQ ID NO: 832478 - DNA, 20 bp, mouse
gcagttcgccccaggaagga

SEQ ID NO: 832479 - DNA, 20 bp, mouse
gaggctgattccttttgtaa

SEQ ID NO: 832480 - DNA, 20 bp, mouse
ggcactgtcaccggtttgaa

SEQ ID NO: 832481 - DNA, 20 bp, mouse
gtgcgcagttcgccccagga

SEQ ID NO: 832482 - DNA, 20 bp, mouse
gcgcttgcgcagttcgcccc

SEQ ID NO: 832483 - DNA, 20 bp, mouse
ggcagccgggagagctgcgg

SEQ ID NO: 832484 - DNA, 20 bp, mouse
gcagcctggtggaggggaaa

SEQ ID NO: 832485 - DNA, 20 bp, mouse
gttgccagggtgaaagcttc

SEQ ID NO: 832486 - DNA, 20 bp, mouse
gcggcagcgcacctacccac

SEQ ID NO: 832487 - DNA, 20 bp, mouse
gcgcacctacccaccggtag

SEQ ID NO: 832488 - DNA, 20 bp, mouse
ggggcgacagagaaccgcgg

SEQ ID NO: 832489 - DNA, 20 bp, mouse
gctgtctccgagcacctccg

SEQ ID NO: 832490 - DNA, 20 bp, mouse
ggatccggaagctcagatct

SEQ ID NO: 832491 - DNA, 20 bp, mouse
gtcgccccctaccggtgggt

SEQ ID NO: 832492 - DNA, 20 bp, mouse
gagcgcttctgtgtgagagg

SEQ ID NO: 832493 - DNA, 20 bp, mouse
gctcgcccgggtcctcgggc

SEQ ID NO: 832494 - DNA, 20 bp, mouse
ggttctctgtcgccccctac

SEQ ID NO: 832495 - DNA, 20 bp, mouse
gtgtgcggagagaatggctt

SEQ ID NO: 832496 - DNA, 20 bp, mouse
ggtaccgcgcctatagacgt

SEQ ID NO: 832497 - DNA, 20 bp, mouse
ggaaccgaggggatctgaaa

SEQ ID NO: 832498 - DNA, 20 bp, mouse
gcgaggggacgaacgaggag

SEQ ID NO: 832499 - DNA, 20 bp, mouse
gcacaggagaagggaggatt

SEQ ID NO: 832500 - DNA, 20 bp, mouse
gtagcgcccaaggcagtgag

SEQ ID NO: 832501 - DNA, 20 bp, mouse
gggagtcgaggggacgaacg

SEQ ID NO: 832502 - DNA, 20 bp, mouse
gagccgttgatggacccaag

SEQ ID NO: 832503 - DNA, 20 bp, mouse
gccttgggcgctaggagtcg

SEQ ID NO: 832504 - DNA, 20 bp, mouse
gtccctctaccaacgtctat

SEQ ID NO: 832505 - DNA, 20 bp, mouse
ggttctggctgcatcctctt

SEQ ID NO: 832506 - DNA, 20 bp, mouse
gggtgcgaggcgggcacaaa

SEQ ID NO: 832507 - DNA, 20 bp, mouse
gccgagggcaatttggtgat

SEQ ID NO: 832508 - DNA, 20 bp, mouse
gggagccaggcgcttgccga

SEQ ID NO: 832509 - DNA, 20 bp, mouse
gctggctccgatgtccccgg

SEQ ID NO: 832510 - DNA, 20 bp, mouse
gaccgaacccccggggacat

SEQ ID NO: 832511 - DNA, 20 bp, mouse
gaggtagcaaccgaaccccc

SEQ ID NO: 832512 - DNA, 20 bp, mouse
gcgggccagagcccggtcgg

SEQ ID NO: 832513 - DNA, 20 bp, mouse
ggctgagtcccttatttccg

SEQ ID NO: 832514 - DNA, 20 bp, mouse
gcggttgctacctagtagag

SEQ ID NO: 832515 - DNA, 20 bp, mouse
ggaggccacgtgaccagcgc

SEQ ID NO: 832516 - DNA, 20 bp, mouse
ggcgctggcgagcacttgga

SEQ ID NO: 832517 - DNA, 20 bp, mouse
ggggaaagaaagaactgtcg

SEQ ID NO: 832518 - DNA, 20 bp, mouse
gccggaaattggagttggaa

SEQ ID NO: 832519 - DNA, 20 bp, mouse
gcgctctgctcgctccatta

SEQ ID NO: 832520 - DNA, 20 bp, mouse
gtggcgccggaaattggagt

SEQ ID NO: 832521 - DNA, 20 bp, mouse
gtgcgcggggcggtcgacgg

SEQ ID NO: 832522 - DNA, 20 bp, mouse
gactgtcgaggctgtggcgt

SEQ ID NO: 832523 - DNA, 20 bp, mouse
gaccccgggagttgaggcgc

SEQ ID NO: 832524 - DNA, 20 bp, mouse
gtccaagagaagaatggcgc

SEQ ID NO: 832525 - DNA, 20 bp, mouse
gggaacggaagcgaagcctt

SEQ ID NO: 832526 - DNA, 20 bp, mouse
ggccgcgcgcaagagggcga

SEQ ID NO: 832527 - DNA, 20 bp, mouse
gcggccgaagccacggtgaa

SEQ ID NO: 832528 - DNA, 20 bp, mouse
gccaccgcctggacgtcctt

SEQ ID NO: 832529 - DNA, 20 bp, mouse
gcgcaagagggcgagggggt

SEQ ID NO: 832530 - DNA, 20 bp, mouse
ggtaagctgccgcgcgcaag

SEQ ID NO: 832531 - DNA, 20 bp, mouse
ggaggtgggaggttgcgaga

SEQ ID NO: 832532 - DNA, 20 bp, mouse
gtcgtcgcgcgaagcgctct

SEQ ID NO: 832533 - DNA, 20 bp, mouse
gagggcgcgcgggagccgaa

SEQ ID NO: 832534 - DNA, 20 bp, mouse
gtgggagcccaaggacgtcc

SEQ ID NO: 832535 - DNA, 20 bp, mouse
ggcgcgcggcagcttacagc

SEQ ID NO: 832536 - DNA, 20 bp, mouse
gcggggcggggctctagcca

SEQ ID NO: 832537 - DNA, 20 bp, mouse
gtctagccagggctaggggc

SEQ ID NO: 832538 - DNA, 20 bp, mouse
gcggccgcgggctgagatac

SEQ ID NO: 832539 - DNA, 20 bp, mouse
ggaatctgagggcagaatgt

SEQ ID NO: 832540 - DNA, 20 bp, mouse
ggtgagccagactgtgtaaa

SEQ ID NO: 832541 - DNA, 20 bp, mouse
gcgggcttcgattccctccg

SEQ ID NO: 832542 - DNA, 20 bp, mouse
gggtcatgagagcagtgtca

SEQ ID NO: 832543 - DNA, 20 bp, mouse
gcctagaacacagggctctg

SEQ ID NO: 832544 - DNA, 20 bp, mouse
gcggggctctagccagggct

SEQ ID NO: 832545 - DNA, 20 bp, mouse
gtcggacgtcgggttacgcg

SEQ ID NO: 832546 - DNA, 20 bp, mouse
gcctctgagcgcttgccttc

SEQ ID NO: 832547 - DNA, 20 bp, mouse
gtcccagcatgccgagaagc

SEQ ID NO: 832548 - DNA, 20 bp, mouse
gccctagcccgtacactcta

SEQ ID NO: 832549 - DNA, 20 bp, mouse
gtgtacgggctagggagctt

SEQ ID NO: 832550 - DNA, 20 bp, mouse
gcgcttgccttccggcttct

SEQ ID NO: 832551 - DNA, 20 bp, mouse
gggcaagtgaagcctaagat

SEQ ID NO: 832552 - DNA, 20 bp, mouse
gtgctgggatacggagtcct

SEQ ID NO: 832553 - DNA, 20 bp, mouse
gcccgtacactctacgggac

SEQ ID NO: 832554 - DNA, 20 bp, mouse
gctcagagggcgtactgccg

SEQ ID NO: 832555 - DNA, 20 bp, mouse
gtacactctacgggaccggt

SEQ ID NO: 832556 - DNA, 20 bp, mouse
ggctgcgcatgcgtcgtagg

SEQ ID NO: 832557 - DNA, 20 bp, mouse
gcggccggagcatctcgctc

SEQ ID NO: 832558 - DNA, 20 bp, mouse
gggcggtcacgtcacgggga

SEQ ID NO: 832559 - DNA, 20 bp, mouse
gcggccgcctccggggtgga

SEQ ID NO: 832560 - DNA, 20 bp, mouse
ggcggagcgctccgagtggg

SEQ ID NO: 832561 - DNA, 20 bp, mouse
gcaggcggagcgctccgagt

SEQ ID NO: 832562 - DNA, 20 bp, mouse
ggagtgggcggtcacgtcac

SEQ ID NO: 832563 - DNA, 20 bp, mouse
gcaggagcacggacagcagt

SEQ ID NO: 832564 - DNA, 20 bp, mouse
gccgccgccgccggggtgtc

SEQ ID NO: 832565 - DNA, 20 bp, mouse
gccgccagagcgagatgctc

SEQ ID NO: 832566 - DNA, 20 bp, mouse
gccgaggcccccaacatata

SEQ ID NO: 832567 - DNA, 20 bp, mouse
ggtacagggcaggattagat

SEQ ID NO: 832568 - DNA, 20 bp, mouse
gtttggggacacagtgatta

SEQ ID NO: 832569 - DNA, 20 bp, mouse
gatggggtggagcccagctg

SEQ ID NO: 832570 - DNA, 20 bp, mouse
gcctcctgcccttaaggtac

SEQ ID NO: 832571 - DNA, 20 bp, mouse
ggcaggaggctgaagggcca

SEQ ID NO: 832572 - DNA, 20 bp, mouse
gaatcctgccctgtacctta

SEQ ID NO: 832573 - DNA, 20 bp, mouse
gaagacttgaagttccaggc

SEQ ID NO: 832574 - DNA, 20 bp, mouse
gataggggaaacactttgta

SEQ ID NO: 832575 - DNA, 20 bp, mouse
gaagaaatggggtaaaacag

SEQ ID NO: 832576 - DNA, 20 bp, mouse
gggagagcgccacccggcca

SEQ ID NO: 832577 - DNA, 20 bp, mouse
ggccgggtggcgctctccct

SEQ ID NO: 832578 - DNA, 20 bp, mouse
gcggtccggggccgactctg

SEQ ID NO: 832579 - DNA, 20 bp, mouse
gcgcctctgcggagccagac

SEQ ID NO: 832580 - DNA, 20 bp, mouse
gcgagggcggccagcgtagg

SEQ ID NO: 832581 - DNA, 20 bp, mouse
gcgcgccgcagagtcggccc

SEQ ID NO: 832582 - DNA, 20 bp, mouse
gcctgcctgcggctgtgtga

SEQ ID NO: 832583 - DNA, 20 bp, mouse
ggggcggccagcgtaggcgg

SEQ ID NO: 832584 - DNA, 20 bp, mouse
gctgcggagccagaccggac

SEQ ID NO: 832585 - DNA, 20 bp, mouse
gagccagaccggaccggacc

SEQ ID NO: 832586 - DNA, 20 bp, mouse
gcaagcttggagtgtgaaga

SEQ ID NO: 832587 - DNA, 20 bp, mouse
gagtctgtctgagcctgccc

SEQ ID NO: 832588 - DNA, 20 bp, mouse
gttcccagaactctgagctg

SEQ ID NO: 832589 - DNA, 20 bp, mouse
gtgtgaagagggtgggactg

SEQ ID NO: 832590 - DNA, 20 bp, mouse
ggacctcaggtcccctgggc

SEQ ID NO: 832591 - DNA, 20 bp, mouse
ggacctcagctcagagttct

SEQ ID NO: 832592 - DNA, 20 bp, mouse
ggggaaggaaaaaatctccg

SEQ ID NO: 832593 - DNA, 20 bp, mouse
gcattaagagggcttggggt

SEQ ID NO: 832594 - DNA, 20 bp, mouse
ggtgtggggcgggactatgc

SEQ ID NO: 832595 - DNA, 20 bp, mouse
gatctggggcccctggaagt

SEQ ID NO: 832596 - DNA, 20 bp, mouse
ggagcagccaatcagagcca

SEQ ID NO: 832597 - DNA, 20 bp, mouse
gagagccagggacgagagct

SEQ ID NO: 832598 - DNA, 20 bp, mouse
ggagagctgggcggggacat

SEQ ID NO: 832599 - DNA, 20 bp, mouse
gcccgcccagctctcgtccc

SEQ ID NO: 832600 - DNA, 20 bp, mouse
gtctgcacgcggcgagtcag

SEQ ID NO: 832601 - DNA, 20 bp, mouse
gcagctctggtctcaattcg

SEQ ID NO: 832602 - DNA, 20 bp, mouse
gacgccgggccttttcccgt

SEQ ID NO: 832603 - DNA, 20 bp, mouse
gcgagcccggaagcggacgg

SEQ ID NO: 832604 - DNA, 20 bp, mouse
gaatgctggccgcccagctc

SEQ ID NO: 832605 - DNA, 20 bp, mouse
gtctcgtccctggctctgat

SEQ ID NO: 832606 - DNA, 20 bp, mouse
ggggccccaccctcgggcga

SEQ ID NO: 832607 - DNA, 20 bp, mouse
gtggggcccgcgcatgcgca

SEQ ID NO: 832608 - DNA, 20 bp, mouse
gtgggcgatcccccgggctc

SEQ ID NO: 832609 - DNA, 20 bp, mouse
ggcaactcttcagtcttctt

SEQ ID NO: 832610 - DNA, 20 bp, mouse
gtgcgcatgggcgatccccc

SEQ ID NO: 832611 - DNA, 20 bp, mouse
gtcaccccctcgcccgaggg

SEQ ID NO: 832612 - DNA, 20 bp, mouse
gccacgaggccagagcccgg

SEQ ID NO: 832613 - DNA, 20 bp, mouse
gtctcgtcggagtgggtgga

SEQ ID NO: 832614 - DNA, 20 bp, mouse
gtaggtagtaggtttctcgt

SEQ ID NO: 832615 - DNA, 20 bp, mouse
gtgaccgcgtagtaaggtca

SEQ ID NO: 832616 - DNA, 20 bp, mouse
ggcgacaactctgcgcgctc

SEQ ID NO: 832617 - DNA, 20 bp, mouse
gaccctgtggtcagtccact

SEQ ID NO: 832618 - DNA, 20 bp, mouse
ggccgagtggactgaccaca

SEQ ID NO: 832619 - DNA, 20 bp, mouse
ggcgcgcagagttgtcgcca

SEQ ID NO: 832620 - DNA, 20 bp, mouse
gccgccgcgggcaccgcctc

SEQ ID NO: 832621 - DNA, 20 bp, mouse
gaactctgcgcgctcaggac

SEQ ID NO: 832622 - DNA, 20 bp, mouse
gagagaggacccaggtccta

SEQ ID NO: 832623 - DNA, 20 bp, mouse
gtaaggctgttgcgtagttc

SEQ ID NO: 832624 - DNA, 20 bp, mouse
gcccagccaagagaggaccc

SEQ ID NO: 832625 - DNA, 20 bp, mouse
gcgggcaccgcctccggccg

SEQ ID NO: 832626 - DNA, 20 bp, mouse
gtggtcggcaaagtcaggag

SEQ ID NO: 832627 - DNA, 20 bp, mouse
ggcgtggcccacaggaggca

SEQ ID NO: 832628 - DNA, 20 bp, mouse
gagggcggggaagagctgca

SEQ ID NO: 832629 - DNA, 20 bp, mouse
ggccacgcccctcccgtctg

SEQ ID NO: 832630 - DNA, 20 bp, mouse
ggacaggcctcagacgggag

SEQ ID NO: 832631 - DNA, 20 bp, mouse
gggagtggctctgagaaaag

SEQ ID NO: 832632 - DNA, 20 bp, mouse
ggtctgcaggggagcggtaa

SEQ ID NO: 832633 - DNA, 20 bp, mouse
gtgtaagccacgccctctcc

SEQ ID NO: 832634 - DNA, 20 bp, mouse
ggcttacagaggcggggcaa

SEQ ID NO: 832635 - DNA, 20 bp, mouse
ggaggcggggctctcggagg

SEQ ID NO: 832636 - DNA, 20 bp, mouse
gtggccctgcgacttcagtg

SEQ ID NO: 832637 - DNA, 20 bp, mouse
gtggctgtagatcttcgggg

SEQ ID NO: 832638 - DNA, 20 bp, mouse
gcagaagcccctcccttccc

SEQ ID NO: 832639 - DNA, 20 bp, mouse
gtaagttggagttgtggggt

SEQ ID NO: 832640 - DNA, 20 bp, mouse
ggcttctgtccgctgctggt

SEQ ID NO: 832641 - DNA, 20 bp, mouse
gcaggaggagagccagtagg

SEQ ID NO: 832642 - DNA, 20 bp, mouse
ggggcagggcctgagccaat

SEQ ID NO: 832643 - DNA, 20 bp, mouse
gtgcagattgggtcagcagg

SEQ ID NO: 832644 - DNA, 20 bp, mouse
gtcagccccactgaagtcgc

SEQ ID NO: 832645 - DNA, 20 bp, mouse
gaggggcttctgtccgctgc

SEQ ID NO: 832646 - DNA, 20 bp, mouse
ggtacagccctatgagagaa

SEQ ID NO: 832647 - DNA, 20 bp, mouse
gcagcctgctggttccagaa

SEQ ID NO: 832648 - DNA, 20 bp, mouse
gtagaggaagaacggtgtta

SEQ ID NO: 832649 - DNA, 20 bp, mouse
gagcctgacccttctctcat

SEQ ID NO: 832650 - DNA, 20 bp, mouse
gtaacccttctggaaccagc

SEQ ID NO: 832651 - DNA, 20 bp, mouse
gactgctgggtcctgggtgg

SEQ ID NO: 832652 - DNA, 20 bp, mouse
gggagatagggtggaactag

SEQ ID NO: 832653 - DNA, 20 bp, mouse
ggctgaggagcccccggagt

SEQ ID NO: 832654 - DNA, 20 bp, mouse
gcccccggagtgggccgaga

SEQ ID NO: 832655 - DNA, 20 bp, mouse
gggcctcagctgtcactgct

SEQ ID NO: 832656 - DNA, 20 bp, mouse
ggatcggggactcggaagtc

SEQ ID NO: 832657 - DNA, 20 bp, mouse
gagaaacagcggtgtggcgg

SEQ ID NO: 832658 - DNA, 20 bp, mouse
ggtacagcctgcagaaacag

SEQ ID NO: 832659 - DNA, 20 bp, mouse
gtacgccaggatcggggact

SEQ ID NO: 832660 - DNA, 20 bp, mouse
ggggctgatgaaggcaacgt

SEQ ID NO: 832661 - DNA, 20 bp, mouse
gaaactgtggactagcggtg

SEQ ID NO: 832662 - DNA, 20 bp, mouse
ggcaacctacgccaggatcg

SEQ ID NO: 832663 - DNA, 20 bp, mouse
ggtcgggctgcgtgcccagg

SEQ ID NO: 832664 - DNA, 20 bp, mouse
ggccacaccgctgtttctgc

SEQ ID NO: 832665 - DNA, 20 bp, mouse
gacgctaaactgtggactag

SEQ ID NO: 832666 - DNA, 20 bp, mouse
gcagaagtgcgatctctcat

SEQ ID NO: 832667 - DNA, 20 bp, mouse
gcgggccgaaggaactacca

SEQ ID NO: 832668 - DNA, 20 bp, mouse
ggacaaggcaaggctggcta

SEQ ID NO: 832669 - DNA, 20 bp, mouse
gctccagccgggcggaggtt

SEQ ID NO: 832670 - DNA, 20 bp, mouse
ggcgccctccagccgggcgg

SEQ ID NO: 832671 - DNA, 20 bp, mouse
gtcagcctggccaacctgaa

SEQ ID NO: 832672 - DNA, 20 bp, mouse
gaggcaaggctggctagggg

SEQ ID NO: 832673 - DNA, 20 bp, mouse
ggccacgcccaacctccgcc

SEQ ID NO: 832674 - DNA, 20 bp, mouse
ggccgcgccctccagccggg

SEQ ID NO: 832675 - DNA, 20 bp, mouse
gggagggcgcggcttttgac

SEQ ID NO: 832676 - DNA, 20 bp, mouse
ggaagcctcgcgggacagtc

SEQ ID NO: 832677 - DNA, 20 bp, mouse
ggcgaggcttccagttacgg

SEQ ID NO: 832678 - DNA, 20 bp, mouse
gcccgcgaggcttccagtta

SEQ ID NO: 832679 - DNA, 20 bp, mouse
gaacccctcggggaccctgt

SEQ ID NO: 832680 - DNA, 20 bp, mouse
gtccagttacggaggatgag

SEQ ID NO: 832681 - DNA, 20 bp, mouse
gtgttcttgcgcagggcatc

SEQ ID NO: 832682 - DNA, 20 bp, mouse
ggcgcagggcatcagggtac

SEQ ID NO: 832683 - DNA, 20 bp, mouse
gaccctggccgatgcacttc

SEQ ID NO: 832684 - DNA, 20 bp, mouse
gggtcacgcggcgtcaacag

SEQ ID NO: 832685 - DNA, 20 bp, mouse
ggtgacgcgcacggagggca

SEQ ID NO: 832686 - DNA, 20 bp, mouse
gtggagtaaccgggagactg

SEQ ID NO: 832687 - DNA, 20 bp, mouse
gaatacggatctctggtctc

SEQ ID NO: 832688 - DNA, 20 bp, mouse
gccggcgccaggtccaaggg

SEQ ID NO: 832689 - DNA, 20 bp, mouse
gttaccttggcggttttagt

SEQ ID NO: 832690 - DNA, 20 bp, mouse
gaggaagaacagctcattat

SEQ ID NO: 832691 - DNA, 20 bp, mouse
gcttccggcgccaggtccaa

SEQ ID NO: 832692 - DNA, 20 bp, mouse
gggtccaagggcggaatctc

SEQ ID NO: 832693 - DNA, 20 bp, mouse
ggcttcttggtgatttagtg

SEQ ID NO: 832694 - DNA, 20 bp, mouse
gctggaaactggatgttctc

SEQ ID NO: 832695 - DNA, 20 bp, mouse
gctagtctgggatgagttgt

SEQ ID NO: 832696 - DNA, 20 bp, mouse
ggctgcccgcggggcactgt

SEQ ID NO: 832697 - DNA, 20 bp, mouse
gccgcccccggcattctgag

SEQ ID NO: 832698 - DNA, 20 bp, mouse
gcccttcgggtcaacccaac

SEQ ID NO: 832699 - DNA, 20 bp, mouse
ggactcccagggtgcccttc

SEQ ID NO: 832700 - DNA, 20 bp, mouse
gcgcgagactctgactccca

SEQ ID NO: 832701 - DNA, 20 bp, mouse
ggtgccccgcgggcagcctg

SEQ ID NO: 832702 - DNA, 20 bp, mouse
gccgcgggcagcctgaggag

SEQ ID NO: 832703 - DNA, 20 bp, mouse
gaactccccactcagaatgc

SEQ ID NO: 832704 - DNA, 20 bp, mouse
gaggaggcgctcagattcgc

SEQ ID NO: 832705 - DNA, 20 bp, mouse
gagaagttgaacccttacgg

SEQ ID NO: 832706 - DNA, 20 bp, mouse
gcccggggctccttgatcgt

SEQ ID NO: 832707 - DNA, 20 bp, mouse
gcggaagcacgatgcttgga

SEQ ID NO: 832708 - DNA, 20 bp, mouse
gggggagggactctcgggga

SEQ ID NO: 832709 - DNA, 20 bp, mouse
gctagaggggagggactctc

SEQ ID NO: 832710 - DNA, 20 bp, mouse
gggagcatgcgcacctggtg

SEQ ID NO: 832711 - DNA, 20 bp, mouse
gggcctctgtgatccctaga

SEQ ID NO: 832712 - DNA, 20 bp, mouse
ggggagggctgtgtgggcgg

SEQ ID NO: 832713 - DNA, 20 bp, mouse
ggcacctggtgaggtaagga

SEQ ID NO: 832714 - DNA, 20 bp, mouse
gtcccctctagggatcacag

SEQ ID NO: 832715 - DNA, 20 bp, mouse
gggacagcgaaagagattaa

SEQ ID NO: 832716 - DNA, 20 bp, mouse
ggggccgtgcggcagtgaca

SEQ ID NO: 832717 - DNA, 20 bp, mouse
ggcacggcccgggagaagga

SEQ ID NO: 832718 - DNA, 20 bp, mouse
ggaagcccgtgtgattctga

SEQ ID NO: 832719 - DNA, 20 bp, mouse
gcccgccctcagaatcacac

SEQ ID NO: 832720 - DNA, 20 bp, mouse
ggtgcggcagtgacagggtg

SEQ ID NO: 832721 - DNA, 20 bp, mouse
gccgccccggcccgtccggt

SEQ ID NO: 832722 - DNA, 20 bp, mouse
gtcaccgaccggacgggccg

SEQ ID NO: 832723 - DNA, 20 bp, mouse
gggagctcacggagtccacg

SEQ ID NO: 832724 - DNA, 20 bp, mouse
gcggcgggccgcccaggtat

SEQ ID NO: 832725 - DNA, 20 bp, mouse
gcccctccgtgccaatacct

SEQ ID NO: 832726 - DNA, 20 bp, mouse
gggtgcctaggattggaata

SEQ ID NO: 832727 - DNA, 20 bp, mouse
gtggaataaggcagcgtccc

SEQ ID NO: 832728 - DNA, 20 bp, mouse
gagagctgctggggcagaaa

SEQ ID NO: 832729 - DNA, 20 bp, mouse
gtgctggggcagaaaaggag

SEQ ID NO: 832730 - DNA, 20 bp, mouse
gtgcctccacggatggccta

SEQ ID NO: 832731 - DNA, 20 bp, mouse
gcaccttaggccatccgtgg

SEQ ID NO: 832732 - DNA, 20 bp, mouse
gtgcctagggtgcctaggat

SEQ ID NO: 832733 - DNA, 20 bp, mouse
gtcaatctgcttagtctcca

SEQ ID NO: 832734 - DNA, 20 bp, mouse
gggagggaacgcaggcacat

SEQ ID NO: 832735 - DNA, 20 bp, mouse
gagagcgtggccccgtgcct

SEQ ID NO: 832736 - DNA, 20 bp, mouse
gagagtgagcgagccgagca

SEQ ID NO: 832737 - DNA, 20 bp, mouse
gacaccaggcggccacccag

SEQ ID NO: 832738 - DNA, 20 bp, mouse
ggcaacgctgggcgtccccg

SEQ ID NO: 832739 - DNA, 20 bp, mouse
ggggtggccgcctggtgtct

SEQ ID NO: 832740 - DNA, 20 bp, mouse
ggtgtcttggcccggaggag

SEQ ID NO: 832741 - DNA, 20 bp, mouse
gggcgtccccggggttgaga

SEQ ID NO: 832742 - DNA, 20 bp, mouse
gggcctgtggagacccgaat

SEQ ID NO: 832743 - DNA, 20 bp, mouse
ggagacccgaataggtagtc

SEQ ID NO: 832744 - DNA, 20 bp, mouse
gtcttggcccggaggagggg

SEQ ID NO: 832745 - DNA, 20 bp, mouse
gagcgagccgagcagggagg

SEQ ID NO: 832746 - DNA, 20 bp, mouse
gtgcgctccgggaacctctc

SEQ ID NO: 832747 - DNA, 20 bp, mouse
gcctcccgaggcctgcgctc

SEQ ID NO: 832748 - DNA, 20 bp, mouse
gtgtgtgccagagaggttcc

SEQ ID NO: 832749 - DNA, 20 bp, mouse
gggcccccgctcgcggccag

SEQ ID NO: 832750 - DNA, 20 bp, mouse
gtctctgggtctccctcccg

SEQ ID NO: 832751 - DNA, 20 bp, mouse
gggccccgagtgaccgtgag

SEQ ID NO: 832752 - DNA, 20 bp, mouse
gggaggtgggcggatccgga

SEQ ID NO: 832753 - DNA, 20 bp, mouse
gttcccggagcgcaggcctc

SEQ ID NO: 832754 - DNA, 20 bp, mouse
gggccggaggtgggcggatc

SEQ ID NO: 832755 - DNA, 20 bp, mouse
ggcggccgatcagcagcagg

SEQ ID NO: 832756 - DNA, 20 bp, mouse
ggggcgccccgcaaccagga

SEQ ID NO: 832757 - DNA, 20 bp, mouse
gtccacgctcacaacaggtg

SEQ ID NO: 832758 - DNA, 20 bp, mouse
gataggagggagatgttcaa

SEQ ID NO: 832759 - DNA, 20 bp, mouse
gcatagagagggcgactgcg

SEQ ID NO: 832760 - DNA, 20 bp, mouse
gtctatgtgctcgaatagga

SEQ ID NO: 832761 - DNA, 20 bp, mouse
ggccccgcaaccaggaaggt

SEQ ID NO: 832762 - DNA, 20 bp, mouse
gttctcgtgcgcgctcctcg

SEQ ID NO: 832763 - DNA, 20 bp, mouse
gggagggagatgttcaaagg

SEQ ID NO: 832764 - DNA, 20 bp, mouse
gaaagtaggtcccaccttcc

SEQ ID NO: 832765 - DNA, 20 bp, mouse
gcctctctatgtgctcgaat

SEQ ID NO: 832766 - DNA, 20 bp, mouse
ggcagccaccgggacgttgg

SEQ ID NO: 832767 - DNA, 20 bp, mouse
gggccctgggaccgcacgtg

SEQ ID NO: 832768 - DNA, 20 bp, mouse
ggcggcgaggccaggggctt

SEQ ID NO: 832769 - DNA, 20 bp, mouse
ggtggccaccaacgtcccgg

SEQ ID NO: 832770 - DNA, 20 bp, mouse
ggcaccaccggctacaccct

SEQ ID NO: 832771 - DNA, 20 bp, mouse
gcagatccgtactcgctcgt

SEQ ID NO: 832772 - DNA, 20 bp, mouse
ggtgcggtcccagggcccgg

SEQ ID NO: 832773 - DNA, 20 bp, mouse
ggagccgcacgtgcggtccc

SEQ ID NO: 832774 - DNA, 20 bp, mouse
gacaccctcggagccggcgg

SEQ ID NO: 832775 - DNA, 20 bp, mouse
gtcggcagccaccgggacgt

SEQ ID NO: 832776 - DNA, 20 bp, mouse
gggcggggcgcgcacgacgg

SEQ ID NO: 832777 - DNA, 20 bp, mouse
gcatgcgcgctcccgcggat

SEQ ID NO: 832778 - DNA, 20 bp, mouse
gacaaccgggagcgtgatgg

SEQ ID NO: 832779 - DNA, 20 bp, mouse
gagtcgtgctcctattcgga

SEQ ID NO: 832780 - DNA, 20 bp, mouse
ggcaccttcaccctccgaat

SEQ ID NO: 832781 - DNA, 20 bp, mouse
gagcacaaccgggagcgtga

SEQ ID NO: 832782 - DNA, 20 bp, mouse
ggcgggctccggacgggcaa

SEQ ID NO: 832783 - DNA, 20 bp, mouse
gcgactcagagaagcacaac

SEQ ID NO: 832784 - DNA, 20 bp, mouse
ggagctatatagcccgaccc

SEQ ID NO: 832785 - DNA, 20 bp, mouse
gcccgcggatgggcgggctc

SEQ ID NO: 832786 - DNA, 20 bp, mouse
ggagggtcctcctttggata

SEQ ID NO: 832787 - DNA, 20 bp, mouse
gaggaggagccgggggtcta

SEQ ID NO: 832788 - DNA, 20 bp, mouse
gtatcgagatagagtaccag

SEQ ID NO: 832789 - DNA, 20 bp, mouse
gggaatggagggtcctcctt

SEQ ID NO: 832790 - DNA, 20 bp, mouse
gacaggaagctgtagaggga

SEQ ID NO: 832791 - DNA, 20 bp, mouse
gcctttggatagggaagaga

SEQ ID NO: 832792 - DNA, 20 bp, mouse
gggagacgagtctgtgacgg

SEQ ID NO: 832793 - DNA, 20 bp, mouse
gagaacgcagaatggatgct

SEQ ID NO: 832794 - DNA, 20 bp, mouse
gcagaatggatgctgggcca

SEQ ID NO: 832795 - DNA, 20 bp, mouse
gggggtctaggggcacctgc

SEQ ID NO: 832796 - DNA, 20 bp, mouse
ggggtctgtggttagagaca

SEQ ID NO: 832797 - DNA, 20 bp, mouse
gctggggcgtctgggaaatg

SEQ ID NO: 832798 - DNA, 20 bp, mouse
gaaccgacgtcggttgtcat

SEQ ID NO: 832799 - DNA, 20 bp, mouse
gacgcagcgctcctaggaat

SEQ ID NO: 832800 - DNA, 20 bp, mouse
gcctgagcggtccgattcct

SEQ ID NO: 832801 - DNA, 20 bp, mouse
ggagggccgaccctagcgtg

SEQ ID NO: 832802 - DNA, 20 bp, mouse
gcacctcaaggaaccgacgt

SEQ ID NO: 832803 - DNA, 20 bp, mouse
gctagggtcggccctcagcg

SEQ ID NO: 832804 - DNA, 20 bp, mouse
ggctaattgcccgccatgtt

SEQ ID NO: 832805 - DNA, 20 bp, mouse
ggggttaacaacctcacgct

SEQ ID NO: 832806 - DNA, 20 bp, mouse
gtacaaagaccatcgggagt

SEQ ID NO: 832807 - DNA, 20 bp, mouse
ggaaactgaggagcagtaac

SEQ ID NO: 832808 - DNA, 20 bp, mouse
gaagaccatcgggagtggga

SEQ ID NO: 832809 - DNA, 20 bp, mouse
gggtcagtcttgggagaaag

SEQ ID NO: 832810 - DNA, 20 bp, mouse
gtaaaagctgggacagagac

SEQ ID NO: 832811 - DNA, 20 bp, mouse
gcctaagtacaaagaccatc

SEQ ID NO: 832812 - DNA, 20 bp, mouse
gctgtctcaggaatcgtcgg

SEQ ID NO: 832813 - DNA, 20 bp, mouse
gtaggggcaaaagagagggt

SEQ ID NO: 832814 - DNA, 20 bp, mouse
gactgaggagcagtaacagg

SEQ ID NO: 832815 - DNA, 20 bp, mouse
gaaagactaggcttgaagga

SEQ ID NO: 832816 - DNA, 20 bp, mouse
gccctgcctgagccaggtga

SEQ ID NO: 832817 - DNA, 20 bp, mouse
gggagcacatgacccacaac

SEQ ID NO: 832818 - DNA, 20 bp, mouse
gtaaaatcgggaccctcacc

SEQ ID NO: 832819 - DNA, 20 bp, mouse
gaggcagggtgcgccagttg

SEQ ID NO: 832820 - DNA, 20 bp, mouse
gtaaacaacttgttgctcat

SEQ ID NO: 832821 - DNA, 20 bp, mouse
ggagacacagtcaagatcat

SEQ ID NO: 832822 - DNA, 20 bp, mouse
gttgcaatgccctggaggtc

SEQ ID NO: 832823 - DNA, 20 bp, mouse
ggccctggaggtctggaagc

SEQ ID NO: 832824 - DNA, 20 bp, mouse
gtccctccctagaaagattc

SEQ ID NO: 832825 - DNA, 20 bp, mouse
gacgacccagaatctttcta

SEQ ID NO: 832826 - DNA, 20 bp, mouse
gggggcggggctcaagactc

SEQ ID NO: 832827 - DNA, 20 bp, mouse
gtataaccgcgagcttctga

SEQ ID NO: 832828 - DNA, 20 bp, mouse
gtgacagagcagttgaaatt

SEQ ID NO: 832829 - DNA, 20 bp, mouse
gaagctctgtccggcttagg

SEQ ID NO: 832830 - DNA, 20 bp, mouse
ggacaagcccagattcacca

SEQ ID NO: 832831 - DNA, 20 bp, mouse
ggaaagttaggcctggttcg

SEQ ID NO: 832832 - DNA, 20 bp, mouse
gaatctgggcttgtcccgtg

SEQ ID NO: 832833 - DNA, 20 bp, mouse
gcgccaggcacccggtgaga

SEQ ID NO: 832834 - DNA, 20 bp, mouse
ggccacggcgtcatccacac

SEQ ID NO: 832835 - DNA, 20 bp, mouse
ggggtgaggaaagttaggcc

SEQ ID NO: 832836 - DNA, 20 bp, mouse
gcgcacgcgctgaagacgtg

SEQ ID NO: 832837 - DNA, 20 bp, mouse
gggaaagggcgtggtctcgg

SEQ ID NO: 832838 - DNA, 20 bp, mouse
gggtcctaggcccagaggat

SEQ ID NO: 832839 - DNA, 20 bp, mouse
gaggcccagggaccctgaag

SEQ ID NO: 832840 - DNA, 20 bp, mouse
gctcgcgcgcgcccggccaa

SEQ ID NO: 832841 - DNA, 20 bp, mouse
gtatggaaagggcgtggtct

SEQ ID NO: 832842 - DNA, 20 bp, mouse
gcgcgcgttggttaaggtga

SEQ ID NO: 832843 - DNA, 20 bp, mouse
ggtaccgcttcagggtccct

SEQ ID NO: 832844 - DNA, 20 bp, mouse
ggaccctgaagcggtacaaa

SEQ ID NO: 832845 - DNA, 20 bp, mouse
gccgacccagctccaaatag

SEQ ID NO: 832846 - DNA, 20 bp, mouse
ggctcaggacaccctcccag

SEQ ID NO: 832847 - DNA, 20 bp, mouse
ggagctcagtcaggtgacta

SEQ ID NO: 832848 - DNA, 20 bp, mouse
gccaggggcaccttagactc

SEQ ID NO: 832849 - DNA, 20 bp, mouse
gtgaacgagctcttctttaa

SEQ ID NO: 832850 - DNA, 20 bp, mouse
gggagggctggagctcagtc

SEQ ID NO: 832851 - DNA, 20 bp, mouse
gcaggacaccctcccagcgg

SEQ ID NO: 832852 - DNA, 20 bp, mouse
gttaactcgctgactgacag

SEQ ID NO: 832853 - DNA, 20 bp, mouse
gctccagccctccgctggga

SEQ ID NO: 832854 - DNA, 20 bp, mouse
gggaagtccgcacgcgtcca

SEQ ID NO: 832855 - DNA, 20 bp, mouse
gaggtgactaaggagtcctc

SEQ ID NO: 832856 - DNA, 20 bp, mouse
gtagaagaggatcacagctg

SEQ ID NO: 832857 - DNA, 20 bp, mouse
gtcccgctccggcccggtga

SEQ ID NO: 832858 - DNA, 20 bp, mouse
gagaatgttctctctcaggt

SEQ ID NO: 832859 - DNA, 20 bp, mouse
gcgcaagcaagggtcttctt

SEQ ID NO: 832860 - DNA, 20 bp, mouse
gagcgcgcgcccccgattaa

SEQ ID NO: 832861 - DNA, 20 bp, mouse
ggcgctctcgcctccgtcac

SEQ ID NO: 832862 - DNA, 20 bp, mouse
gtccgccccctcctccggga

SEQ ID NO: 832863 - DNA, 20 bp, mouse
gtctctcaggtgggaagagt

SEQ ID NO: 832864 - DNA, 20 bp, mouse
gtccagcggcccctttaatc

SEQ ID NO: 832865 - DNA, 20 bp, mouse
gggcgtctcaaagaaacctc

SEQ ID NO: 832866 - DNA, 20 bp, mouse
gacgtcagagcgcccagctc

SEQ ID NO: 832867 - DNA, 20 bp, mouse
ggggcggggttcaaagttct

SEQ ID NO: 832868 - DNA, 20 bp, mouse
ggccctgaacgcaaggtgat

SEQ ID NO: 832869 - DNA, 20 bp, mouse
gttctcggatgagcgagaag

SEQ ID NO: 832870 - DNA, 20 bp, mouse
gctccgagccgagtgggaga

SEQ ID NO: 832871 - DNA, 20 bp, mouse
ggggccacggcaaagcaggt

SEQ ID NO: 832872 - DNA, 20 bp, mouse
gggcccgcgcgcggccttat

SEQ ID NO: 832873 - DNA, 20 bp, mouse
gcacctcgcgttcctgactt

SEQ ID NO: 832874 - DNA, 20 bp, mouse
gtcactgcacgcgacgtacc

SEQ ID NO: 832875 - DNA, 20 bp, mouse
gtgatcggcgcagagacaag

SEQ ID NO: 832876 - DNA, 20 bp, mouse
ggcaccccactcccaggccg

SEQ ID NO: 832877 - DNA, 20 bp, mouse
ggggcctacacagccgggtg

SEQ ID NO: 832878 - DNA, 20 bp, mouse
gccagcagaggccaagaccc

SEQ ID NO: 832879 - DNA, 20 bp, mouse
gaatgccggtaggtagataa

SEQ ID NO: 832880 - DNA, 20 bp, mouse
gctctcggggcctacacagc

SEQ ID NO: 832881 - DNA, 20 bp, mouse
gactgtcctcggcctgggag

SEQ ID NO: 832882 - DNA, 20 bp, mouse
gcttccccacccggctgtgt

SEQ ID NO: 832883 - DNA, 20 bp, mouse
ggtgtaggccccgagagcgc

SEQ ID NO: 832884 - DNA, 20 bp, mouse
gtcaaggcatgaatgccggt

SEQ ID NO: 832885 - DNA, 20 bp, mouse
gctgtgcactctgctctcta

SEQ ID NO: 832886 - DNA, 20 bp, mouse
gggtgagccagtttgataca

SEQ ID NO: 832887 - DNA, 20 bp, mouse
gatggggcggggcttggttc

SEQ ID NO: 832888 - DNA, 20 bp, mouse
gcggggcttggttccggctt

SEQ ID NO: 832889 - DNA, 20 bp, mouse
gatgcccagccaatcacctc

SEQ ID NO: 832890 - DNA, 20 bp, mouse
ggggaggaacctgaggtgat

SEQ ID NO: 832891 - DNA, 20 bp, mouse
gttccggcttgggagtagtg

SEQ ID NO: 832892 - DNA, 20 bp, mouse
gcatcatcctaggcggtctt

SEQ ID NO: 832893 - DNA, 20 bp, mouse
gcatcacccgaagaccgcct

SEQ ID NO: 832894 - DNA, 20 bp, mouse
gggtaccaggctggtagaag

SEQ ID NO: 832895 - DNA, 20 bp, mouse
gcggtcttcgggtgatgggg

SEQ ID NO: 832896 - DNA, 20 bp, mouse
gcccccgcggcaatgtcacg

SEQ ID NO: 832897 - DNA, 20 bp, mouse
ggggcggtgccccaagtcta

SEQ ID NO: 832898 - DNA, 20 bp, mouse
ggtgtccgggtcatagcctc

SEQ ID NO: 832899 - DNA, 20 bp, mouse
gggcgcccgaggctatgacc

SEQ ID NO: 832900 - DNA, 20 bp, mouse
gagtccgcgcagcccgggcc

SEQ ID NO: 832901 - DNA, 20 bp, mouse
ggggccggagggtacagagt

SEQ ID NO: 832902 - DNA, 20 bp, mouse
ggcccaggtcccttagactt

SEQ ID NO: 832903 - DNA, 20 bp, mouse
ggctcgggagttgtagtctc

SEQ ID NO: 832904 - DNA, 20 bp, mouse
gtgcctgtgcatgtcgcctg

SEQ ID NO: 832905 - DNA, 20 bp, mouse
gagccacaggcgacatgcac

SEQ ID NO: 832906 - DNA, 20 bp, mouse
gagacaggaagtagttgttt

SEQ ID NO: 832907 - DNA, 20 bp, mouse
ggggagctgtatgtagtttg

SEQ ID NO: 832908 - DNA, 20 bp, mouse
gaacccacaaaactgtagga

SEQ ID NO: 832909 - DNA, 20 bp, mouse
gtccggaagaggcaaagtcc

SEQ ID NO: 832910 - DNA, 20 bp, mouse
gtgtggggaggataaagtac

SEQ ID NO: 832911 - DNA, 20 bp, mouse
gcctgtctcagattcgtaaa

SEQ ID NO: 832912 - DNA, 20 bp, mouse
gaaactgtaggaaggaagtt

SEQ ID NO: 832913 - DNA, 20 bp, mouse
gcatacatacatgtcacttc

SEQ ID NO: 832914 - DNA, 20 bp, mouse
ggaagagaagaggagcgtgt

SEQ ID NO: 832915 - DNA, 20 bp, mouse
gaagggacactcttgcttca

SEQ ID NO: 832916 - DNA, 20 bp, mouse
gcagccccgggtgacggtga

SEQ ID NO: 832917 - DNA, 20 bp, mouse
gtgagggaaccggggacggg

SEQ ID NO: 832918 - DNA, 20 bp, mouse
gagggggggaggtacaagac

SEQ ID NO: 832919 - DNA, 20 bp, mouse
gacggtgagggaaccgggga

SEQ ID NO: 832920 - DNA, 20 bp, mouse
ggttccctcaccgtcacccg

SEQ ID NO: 832921 - DNA, 20 bp, mouse
gtactccggggtccccgtcg

SEQ ID NO: 832922 - DNA, 20 bp, mouse
ggtccccgtcgcggggcttc

SEQ ID NO: 832923 - DNA, 20 bp, mouse
gggtgacggtgagggaaccg

SEQ ID NO: 832924 - DNA, 20 bp, mouse
gcaggcaagcgcgtccacct

SEQ ID NO: 832925 - DNA, 20 bp, mouse
ggggtggtggagaactacgc

SEQ ID NO: 832926 - DNA, 20 bp, mouse
gctgggcttcccacaggcga

SEQ ID NO: 832927 - DNA, 20 bp, mouse
gtggccgcgcctggcaccgc

SEQ ID NO: 832928 - DNA, 20 bp, mouse
ggcgtccggcggtccagact

SEQ ID NO: 832929 - DNA, 20 bp, mouse
gtggagatggggtgtgcccg

SEQ ID NO: 832930 - DNA, 20 bp, mouse
gagagaaaccaggcgtccgg

SEQ ID NO: 832931 - DNA, 20 bp, mouse
gtccagactgggcttcccac

SEQ ID NO: 832932 - DNA, 20 bp, mouse
gtatggggtgaagtctgggt

SEQ ID NO: 832933 - DNA, 20 bp, mouse
gaaggtcgcaagcgcgagcg

SEQ ID NO: 832934 - DNA, 20 bp, mouse
gcgggggcggggtcagcgga

SEQ ID NO: 832935 - DNA, 20 bp, mouse
ggaagcccagtctggaccgc

SEQ ID NO: 832936 - DNA, 20 bp, mouse
ggggctagcaatagctctaa

SEQ ID NO: 832937 - DNA, 20 bp, mouse
gctggcgaggggtgaggcta

SEQ ID NO: 832938 - DNA, 20 bp, mouse
gaggggtgaggctatggctt

SEQ ID NO: 832939 - DNA, 20 bp, mouse
gggtcctgggggaggtgata

SEQ ID NO: 832940 - DNA, 20 bp, mouse
gaaggggcgtggctcattat

SEQ ID NO: 832941 - DNA, 20 bp, mouse
gagggcggggctgataatcg

SEQ ID NO: 832942 - DNA, 20 bp, mouse
gggcatctttgagctggcga

SEQ ID NO: 832943 - DNA, 20 bp, mouse
gtgggggagagaaaactccc

SEQ ID NO: 832944 - DNA, 20 bp, mouse
ggggagagaaaactccccgg

SEQ ID NO: 832945 - DNA, 20 bp, mouse
gtggctcattattggaaggg

SEQ ID NO: 832946 - DNA, 20 bp, mouse
gaaggaagatgcggtgaaca

SEQ ID NO: 832947 - DNA, 20 bp, mouse
ggacagctggagaggagttg

SEQ ID NO: 832948 - DNA, 20 bp, mouse
gtcgccagggcccttctaag

SEQ ID NO: 832949 - DNA, 20 bp, mouse
gctaaaggggagaagcaaca

SEQ ID NO: 832950 - DNA, 20 bp, mouse
gcgggaggatcaagcagcgt

SEQ ID NO: 832951 - DNA, 20 bp, mouse
gtagaagggccctggcgagc

SEQ ID NO: 832952 - DNA, 20 bp, mouse
gcccagaaggggcaggcgga

SEQ ID NO: 832953 - DNA, 20 bp, mouse
gacagggccgagagacagaa

SEQ ID NO: 832954 - DNA, 20 bp, mouse
gccaagaaaggactactgga

SEQ ID NO: 832955 - DNA, 20 bp, mouse
ggggcgcgctggctccagct

SEQ ID NO: 832956 - DNA, 20 bp, mouse
gcaacccttgccagtctgac

SEQ ID NO: 832957 - DNA, 20 bp, mouse
ggagcctgtcagactggcaa

SEQ ID NO: 832958 - DNA, 20 bp, mouse
gctcaggccagcgctaccca

SEQ ID NO: 832959 - DNA, 20 bp, mouse
ggcaacggagtctgtttctc

SEQ ID NO: 832960 - DNA, 20 bp, mouse
gtgtcaaatcggaacgtctg

SEQ ID NO: 832961 - DNA, 20 bp, mouse
gctggcaagggttgcaacag

SEQ ID NO: 832962 - DNA, 20 bp, mouse
gctgcaggagcctgtcagac

SEQ ID NO: 832963 - DNA, 20 bp, mouse
gtgggtcggtgctcacttga

SEQ ID NO: 832964 - DNA, 20 bp, mouse
gcctggactccagagggcta

SEQ ID NO: 832965 - DNA, 20 bp, mouse
ggtgtcattcggcactggga

SEQ ID NO: 832966 - DNA, 20 bp, mouse
gccaaacggaagtgagtatg

SEQ ID NO: 832967 - DNA, 20 bp, mouse
gcacaacagttcttgttaga

SEQ ID NO: 832968 - DNA, 20 bp, mouse
gtgagtatgaggtgaatctc

SEQ ID NO: 832969 - DNA, 20 bp, mouse
gtgtgcttggttctggtgtt

SEQ ID NO: 832970 - DNA, 20 bp, mouse
ggttagagggtggctttatt

SEQ ID NO: 832971 - DNA, 20 bp, mouse
gaatgaagaagtctcagtcc

SEQ ID NO: 832972 - DNA, 20 bp, mouse
gctgataaacacgaaagatg

SEQ ID NO: 832973 - DNA, 20 bp, mouse
gccatgttgttcttacacat

SEQ ID NO: 832974 - DNA, 20 bp, mouse
ggtctctgcaagtggccgaa

SEQ ID NO: 832975 - DNA, 20 bp, mouse
gagcactgacattcgtcctt

SEQ ID NO: 832976 - DNA, 20 bp, mouse
gcgggtgcggggaattggga

SEQ ID NO: 832977 - DNA, 20 bp, mouse
gcggagcgaggggacccccg

SEQ ID NO: 832978 - DNA, 20 bp, mouse
gacagggcggtgcgtggagg

SEQ ID NO: 832979 - DNA, 20 bp, mouse
gcgtgacagagggactgtct

SEQ ID NO: 832980 - DNA, 20 bp, mouse
gtcaccgggtgcggggaatt

SEQ ID NO: 832981 - DNA, 20 bp, mouse
ggggctccactcgcaggggc

SEQ ID NO: 832982 - DNA, 20 bp, mouse
ggcgacagggcggtgcgtgg

SEQ ID NO: 832983 - DNA, 20 bp, mouse
ggggctccgggactcgctct

SEQ ID NO: 832984 - DNA, 20 bp, mouse
gctcctgggggcgtgacaga

SEQ ID NO: 832985 - DNA, 20 bp, mouse
ggaagacctgagcgacaggg

SEQ ID NO: 832986 - DNA, 20 bp, mouse
gcggctagccatctagatac

SEQ ID NO: 832987 - DNA, 20 bp, mouse
gcctgcctacccagcccgac

SEQ ID NO: 832988 - DNA, 20 bp, mouse
gctacccagcccgactggga

SEQ ID NO: 832989 - DNA, 20 bp, mouse
gtgacgctgaccatctgtcc

SEQ ID NO: 832990 - DNA, 20 bp, mouse
gataccggatccttcccagt

SEQ ID NO: 832991 - DNA, 20 bp, mouse
gggacccaagcctggacaga

SEQ ID NO: 832992 - DNA, 20 bp, mouse
gagcaagcgctcttcctcta

SEQ ID NO: 832993 - DNA, 20 bp, mouse
gcagggcggggacccaagcc

SEQ ID NO: 832994 - DNA, 20 bp, mouse
gcactccaagccactgctgt

SEQ ID NO: 832995 - DNA, 20 bp, mouse
gaggggcggagcctctgcga

SEQ ID NO: 832996 - DNA, 20 bp, mouse
gaaggtgggtcacacactac

SEQ ID NO: 832997 - DNA, 20 bp, mouse
gcccggaacgcaatacctat

SEQ ID NO: 832998 - DNA, 20 bp, mouse
gcgccccacgggcctactgt

SEQ ID NO: 832999 - DNA, 20 bp, mouse
ggcgttccgggatagagttg

SEQ ID NO: 833000 - DNA, 20 bp, mouse
gaggcagttcgacctgcaga

SEQ ID NO: 833001 - DNA, 20 bp, mouse
ggactcaaacttagtgagag

SEQ ID NO: 833002 - DNA, 20 bp, mouse
ggttgcgggcagatcaccaa

SEQ ID NO: 833003 - DNA, 20 bp, mouse
gttcgacctgcagaagggtg

SEQ ID NO: 833004 - DNA, 20 bp, mouse
gtagactagttgcaaaactg

SEQ ID NO: 833005 - DNA, 20 bp, mouse
gccagcctacagtaggcccg

SEQ ID NO: 833006 - DNA, 20 bp, mouse
ggggaagcgctgaggtatct

SEQ ID NO: 833007 - DNA, 20 bp, mouse
gatcgggctaagaatgggat

SEQ ID NO: 833008 - DNA, 20 bp, mouse
gggtgtgcgcaatgcatgct

SEQ ID NO: 833009 - DNA, 20 bp, mouse
gcagtcatcgggctaagaat

SEQ ID NO: 833010 - DNA, 20 bp, mouse
gcacaccacacacacggcaa

SEQ ID NO: 833011 - DNA, 20 bp, mouse
gatcctgggaagtcagtcat

SEQ ID NO: 833012 - DNA, 20 bp, mouse
gaaaaccaaccgggtagtgg

SEQ ID NO: 833013 - DNA, 20 bp, mouse
gtgctgttgacgagcatcct

SEQ ID NO: 833014 - DNA, 20 bp, mouse
gacgctggcctcaaagtact

SEQ ID NO: 833015 - DNA, 20 bp, mouse
gtttgcccttgccgtgtgtg

SEQ ID NO: 833016 - DNA, 20 bp, mouse
gtactctgacggtttattga

SEQ ID NO: 833017 - DNA, 20 bp, mouse
ggggctgaccttgagaacgc

SEQ ID NO: 833018 - DNA, 20 bp, mouse
gggtgtgaggctagggcggg

SEQ ID NO: 833019 - DNA, 20 bp, mouse
gggggcgcaggcgcacaggt

SEQ ID NO: 833020 - DNA, 20 bp, mouse
gttccgtgggtgtgaggcta

SEQ ID NO: 833021 - DNA, 20 bp, mouse
ggaccccacgccacgcagag

SEQ ID NO: 833022 - DNA, 20 bp, mouse
gcgccctagcctcacaccca

SEQ ID NO: 833023 - DNA, 20 bp, mouse
gaaaaataccgcacctacct

SEQ ID NO: 833024 - DNA, 20 bp, mouse
gtctctaaagccacttccgt

SEQ ID NO: 833025 - DNA, 20 bp, mouse
gcttgagaacgcaggggcgc

SEQ ID NO: 833026 - DNA, 20 bp, mouse
ggaagctgagggaactgtta

SEQ ID NO: 833027 - DNA, 20 bp, mouse
gaatccgcgacgtgagtggg

SEQ ID NO: 833028 - DNA, 20 bp, mouse
gccagcctgcgggtagcgca

SEQ ID NO: 833029 - DNA, 20 bp, mouse
ggactgcagagtaattaggg

SEQ ID NO: 833030 - DNA, 20 bp, mouse
gcactggtatcgatgcaccc

SEQ ID NO: 833031 - DNA, 20 bp, mouse
gcgcgcgtgggcaggagaga

SEQ ID NO: 833032 - DNA, 20 bp, mouse
ggggtggaagggtccctcct

SEQ ID NO: 833033 - DNA, 20 bp, mouse
gcacgcgtctggaccgtccg

SEQ ID NO: 833034 - DNA, 20 bp, mouse
ggcgccccccactcacgtcg

SEQ ID NO: 833035 - DNA, 20 bp, mouse
ggaggactgcagagtaatta

SEQ ID NO: 833036 - DNA, 20 bp, mouse
gagggagtgaagtggatcgg

SEQ ID NO: 833037 - DNA, 20 bp, mouse
gtggagggagttggcgacga

SEQ ID NO: 833038 - DNA, 20 bp, mouse
gtgggaagcgaggacgaagt

SEQ ID NO: 833039 - DNA, 20 bp, mouse
ggaagtgggtaggctgtgga

SEQ ID NO: 833040 - DNA, 20 bp, mouse
gtggacgggaggagggccga

SEQ ID NO: 833041 - DNA, 20 bp, mouse
gtggccgccgagtccccctg

SEQ ID NO: 833042 - DNA, 20 bp, mouse
ggagagggaggggaaaccgg

SEQ ID NO: 833043 - DNA, 20 bp, mouse
gggaggagggccgaaggtgg

SEQ ID NO: 833044 - DNA, 20 bp, mouse
gggcccgagaaccaggtcaa

SEQ ID NO: 833045 - DNA, 20 bp, mouse
ggggcaggaggtgggaagcg

SEQ ID NO: 833046 - DNA, 20 bp, mouse
gccggcgcgccgggtccaat

SEQ ID NO: 833047 - DNA, 20 bp, mouse
gtgggacccgagaggacgca

SEQ ID NO: 833048 - DNA, 20 bp, mouse
gtttccggcaggttgaggtg

SEQ ID NO: 833049 - DNA, 20 bp, mouse
gctctccagggccaataagg

SEQ ID NO: 833050 - DNA, 20 bp, mouse
ggagccgcacctcaacctgc

SEQ ID NO: 833051 - DNA, 20 bp, mouse
gctcttgaggaagtactggt

SEQ ID NO: 833052 - DNA, 20 bp, mouse
ggcgtcgtgacgtttccggc

SEQ ID NO: 833053 - DNA, 20 bp, mouse
ggactctccctgcgtcctct

SEQ ID NO: 833054 - DNA, 20 bp, mouse
gacgacgccgggctgacgtc

SEQ ID NO: 833055 - DNA, 20 bp, mouse
gcccggcgtcgtgacgtttc

SEQ ID NO: 833056 - DNA, 20 bp, mouse
ggggcgcatcggtttatctc

SEQ ID NO: 833057 - DNA, 20 bp, mouse
gagtctgaatggtgcggcat

SEQ ID NO: 833058 - DNA, 20 bp, mouse
gagagaatccgctaataccg

SEQ ID NO: 833059 - DNA, 20 bp, mouse
ggagaggtagggcccggaag

SEQ ID NO: 833060 - DNA, 20 bp, mouse
gaccgtggtttgcgagtcgt

SEQ ID NO: 833061 - DNA, 20 bp, mouse
gtattagcggattctctcat

SEQ ID NO: 833062 - DNA, 20 bp, mouse
gtcgcaaaccacggtattag

SEQ ID NO: 833063 - DNA, 20 bp, mouse
gtaccggaagaggtgggact

SEQ ID NO: 833064 - DNA, 20 bp, mouse
gaatggtgcggcatgggcgg

SEQ ID NO: 833065 - DNA, 20 bp, mouse
gggccaagtcccacctcttc

SEQ ID NO: 833066 - DNA, 20 bp, mouse
ggtctgcgtccctacgtagt

SEQ ID NO: 833067 - DNA, 20 bp, mouse
ggagcaagcaggcggacttc

SEQ ID NO: 833068 - DNA, 20 bp, mouse
gcgctctcctcccactacgt

SEQ ID NO: 833069 - DNA, 20 bp, mouse
ggaggagagcgtgttgggcg

SEQ ID NO: 833070 - DNA, 20 bp, mouse
gtgcgtccctacgtagtggg

SEQ ID NO: 833071 - DNA, 20 bp, mouse
gagggacgcagacgctacgc

SEQ ID NO: 833072 - DNA, 20 bp, mouse
gacgctacgcaggcagggcg

SEQ ID NO: 833073 - DNA, 20 bp, mouse
gtaattagacaggagcaagc

SEQ ID NO: 833074 - DNA, 20 bp, mouse
gcgcaggcagggcgaggctt

SEQ ID NO: 833075 - DNA, 20 bp, mouse
gccggttgccatgaccacaa

SEQ ID NO: 833076 - DNA, 20 bp, mouse
gagaacgcggaggtgatgtg

SEQ ID NO: 833077 - DNA, 20 bp, mouse
ggagcctccgagccagaacg

SEQ ID NO: 833078 - DNA, 20 bp, mouse
gaaactgagccagctagagt

SEQ ID NO: 833079 - DNA, 20 bp, mouse
gcctccgagccagaacgcgg

SEQ ID NO: 833080 - DNA, 20 bp, mouse
gacgcccagcggcgagcctg

SEQ ID NO: 833081 - DNA, 20 bp, mouse
gtggtgggatcgatgctcgg

SEQ ID NO: 833082 - DNA, 20 bp, mouse
gcgccgctgggcgtggagag

SEQ ID NO: 833083 - DNA, 20 bp, mouse
gcgctgcgctgccccaccct

SEQ ID NO: 833084 - DNA, 20 bp, mouse
ggggaagaccacggatgatc

SEQ ID NO: 833085 - DNA, 20 bp, mouse
gcctccccaggctcgccgct

SEQ ID NO: 833086 - DNA, 20 bp, mouse
gtacccgagctggacctctg

SEQ ID NO: 833087 - DNA, 20 bp, mouse
gtggccgtggtcaccggcgg

SEQ ID NO: 833088 - DNA, 20 bp, mouse
gactaatagagctacttctg

SEQ ID NO: 833089 - DNA, 20 bp, mouse
gcgggaccacgcggacttag

SEQ ID NO: 833090 - DNA, 20 bp, mouse
ggggttgctgaagaaccaag

SEQ ID NO: 833091 - DNA, 20 bp, mouse
gccaatgcctgtgcccccgc

SEQ ID NO: 833092 - DNA, 20 bp, mouse
gcttaggggcggggtctgtt

SEQ ID NO: 833093 - DNA, 20 bp, mouse
ggaggcctgctcacgtaccc

SEQ ID NO: 833094 - DNA, 20 bp, mouse
ggtacgtgagcaggcctctg

SEQ ID NO: 833095 - DNA, 20 bp, mouse
gcccgggagctcctgcacct

SEQ ID NO: 833096 - DNA, 20 bp, mouse
ggggcagtgcggggccccta

SEQ ID NO: 833097 - DNA, 20 bp, mouse
gctctccaaggggaagcctc

SEQ ID NO: 833098 - DNA, 20 bp, mouse
gactaggccacgttaggctg

SEQ ID NO: 833099 - DNA, 20 bp, mouse
gtcggggaagcccaggtacc

SEQ ID NO: 833100 - DNA, 20 bp, mouse
gcccttggagaggcgagcca

SEQ ID NO: 833101 - DNA, 20 bp, mouse
gtccaaggggaagcctctgg

SEQ ID NO: 833102 - DNA, 20 bp, mouse
gctagtgctgctgaaaatgg

SEQ ID NO: 833103 - DNA, 20 bp, mouse
gacgggcccgcagcctaacg

SEQ ID NO: 833104 - DNA, 20 bp, mouse
gcggctttaaagcaagacgg

SEQ ID NO: 833105 - DNA, 20 bp, mouse
gtcctccagaggcttcccct

SEQ ID NO: 833106 - DNA, 20 bp, mouse
gacagggcgccgcagatgga

SEQ ID NO: 833107 - DNA, 20 bp, mouse
gtaggggcgcagcatgccgt

SEQ ID NO: 833108 - DNA, 20 bp, mouse
gttaaaggtggcactaaaga

SEQ ID NO: 833109 - DNA, 20 bp, mouse
gagagcccaacacacccaga

SEQ ID NO: 833110 - DNA, 20 bp, mouse
gcaactggggttggaatcta

SEQ ID NO: 833111 - DNA, 20 bp, mouse
gtaatcgaacgcagcgccag

SEQ ID NO: 833112 - DNA, 20 bp, mouse
gcgaacgcagcgccaggggg

SEQ ID NO: 833113 - DNA, 20 bp, mouse
gcagaagaaacttgccacta

SEQ ID NO: 833114 - DNA, 20 bp, mouse
gtagggatgtgcagctaggc

SEQ ID NO: 833115 - DNA, 20 bp, mouse
gtgctccatctgggtgtgtt

SEQ ID NO: 833116 - DNA, 20 bp, mouse
gggagcgccacctacgtcac

SEQ ID NO: 833117 - DNA, 20 bp, mouse
gcctaggcacccgggagctc

SEQ ID NO: 833118 - DNA, 20 bp, mouse
gcgcgccgccctaggcaccc

SEQ ID NO: 833119 - DNA, 20 bp, mouse
ggtggcgccagtgacgtagg

SEQ ID NO: 833120 - DNA, 20 bp, mouse
gtccgcccgcagtggggcgg

SEQ ID NO: 833121 - DNA, 20 bp, mouse
gcgcgcgcgcgcgccgccct

SEQ ID NO: 833122 - DNA, 20 bp, mouse
gcagccgctcacccccgggg

SEQ ID NO: 833123 - DNA, 20 bp, mouse
gaatgagcggcgagacccag

SEQ ID NO: 833124 - DNA, 20 bp, mouse
gcgctcattggctgctccga

SEQ ID NO: 833125 - DNA, 20 bp, mouse
gtcccagcgtccgcccgcag

SEQ ID NO: 833126 - DNA, 20 bp, mouse
gaccgggcgctgccctcctg

SEQ ID NO: 833127 - DNA, 20 bp, mouse
ggaccagcagcgcaggtaag

SEQ ID NO: 833128 - DNA, 20 bp, mouse
gaggcaccggcgcgccgctc

SEQ ID NO: 833129 - DNA, 20 bp, mouse
gagggctggccggtaggatc

SEQ ID NO: 833130 - DNA, 20 bp, mouse
ggcaagcgagggatcgacgt

SEQ ID NO: 833131 - DNA, 20 bp, mouse
ggcgcgccggtgcctcagga

SEQ ID NO: 833132 - DNA, 20 bp, mouse
gcgctccggagcacagaact

SEQ ID NO: 833133 - DNA, 20 bp, mouse
gcagggcagggctggccggt

SEQ ID NO: 833134 - DNA, 20 bp, mouse
gagagcccggctcgcgggtg

SEQ ID NO: 833135 - DNA, 20 bp, mouse
gggagggcagcgcccggtgg

SEQ ID NO: 833136 - DNA, 20 bp, mouse
gcctctaatttcccagtctc

SEQ ID NO: 833137 - DNA, 20 bp, mouse
ggggggagagcactcttttc

SEQ ID NO: 833138 - DNA, 20 bp, mouse
gctctcccccctcccccgga

SEQ ID NO: 833139 - DNA, 20 bp, mouse
gtccaggtccagatagccaa

SEQ ID NO: 833140 - DNA, 20 bp, mouse
ggggaggggaggggttagac

SEQ ID NO: 833141 - DNA, 20 bp, mouse
gcagtctcaggatggttgag

SEQ ID NO: 833142 - DNA, 20 bp, mouse
ggaactgaactgagcgaaac

SEQ ID NO: 833143 - DNA, 20 bp, mouse
gaaacaggattagaagcctt

SEQ ID NO: 833144 - DNA, 20 bp, mouse
gggtactagaattaaatgaa

SEQ ID NO: 833145 - DNA, 20 bp, mouse
gtcaggatggttgagtggga

SEQ ID NO: 833146 - DNA, 20 bp, mouse
gaagcctgaagtttgtttgt

SEQ ID NO: 833147 - DNA, 20 bp, mouse
gacaacgacaacgacaatgt

SEQ ID NO: 833148 - DNA, 20 bp, mouse
ggccctgcctgcaatatgga

SEQ ID NO: 833149 - DNA, 20 bp, mouse
gggaatggctcatcagaaat

SEQ ID NO: 833150 - DNA, 20 bp, mouse
gtagttagagaaggaccttt

SEQ ID NO: 833151 - DNA, 20 bp, mouse
gtccctccatattgcaggca

SEQ ID NO: 833152 - DNA, 20 bp, mouse
ggtgtgagagtggggaacac

SEQ ID NO: 833153 - DNA, 20 bp, mouse
ggagtggggaacacaggctc

SEQ ID NO: 833154 - DNA, 20 bp, mouse
gaaggacctttgggcttccg

SEQ ID NO: 833155 - DNA, 20 bp, mouse
ggctttggtaggacagaaac

SEQ ID NO: 833156 - DNA, 20 bp, mouse
gggcgcgggcggaagatggc

SEQ ID NO: 833157 - DNA, 20 bp, mouse
gtgcagcagcgacatggcgt

SEQ ID NO: 833158 - DNA, 20 bp, mouse
gcagctgcgggcgaacaacc

SEQ ID NO: 833159 - DNA, 20 bp, mouse
gtaacccggcagtgcggagc

SEQ ID NO: 833160 - DNA, 20 bp, mouse
gctggggtgtggttcgagtc

SEQ ID NO: 833161 - DNA, 20 bp, mouse
gcctaggaggcacggaggta

SEQ ID NO: 833162 - DNA, 20 bp, mouse
gtcgcccgcagctgctaacc

SEQ ID NO: 833163 - DNA, 20 bp, mouse
gcagggcggggccgcagcgt

SEQ ID NO: 833164 - DNA, 20 bp, mouse
gacgccttacgcctcaccct

SEQ ID NO: 833165 - DNA, 20 bp, mouse
gtggggcagacagtggagct

SEQ ID NO: 833166 - DNA, 20 bp, mouse
ggtgggcgaggtaagagctg

SEQ ID NO: 833167 - DNA, 20 bp, mouse
ggggactgagggccccttta

SEQ ID NO: 833168 - DNA, 20 bp, mouse
ggggtgggagccagaagggg

SEQ ID NO: 833169 - DNA, 20 bp, mouse
gcctgctggaaaacccctaa

SEQ ID NO: 833170 - DNA, 20 bp, mouse
gcagcaggcagctcctcact

SEQ ID NO: 833171 - DNA, 20 bp, mouse
ggcgaggtaagagctggggt

SEQ ID NO: 833172 - DNA, 20 bp, mouse
ggagctggagaaggtgggcg

SEQ ID NO: 833173 - DNA, 20 bp, mouse
ggctaccaaggggccgtgaa

SEQ ID NO: 833174 - DNA, 20 bp, mouse
gggaaagggccccacttgag

SEQ ID NO: 833175 - DNA, 20 bp, mouse
gcctgctggagcagggatac

SEQ ID NO: 833176 - DNA, 20 bp, mouse
gggaaagggccccacttgag

SEQ ID NO: 833177 - DNA, 20 bp, mouse
gcctgctggagcagggatac

SEQ ID NO: 833178 - DNA, 20 bp, mouse
gccatcaggagtagatgatc

SEQ ID NO: 833179 - DNA, 20 bp, mouse
ggtgggcgaggtaagagctg

SEQ ID NO: 833180 - DNA, 20 bp, mouse
gcacttgaggggggtccatc

SEQ ID NO: 833181 - DNA, 20 bp, mouse
ggggtgggagccagaagggg

SEQ ID NO: 833182 - DNA, 20 bp, mouse
ggggactgagggccccttta

SEQ ID NO: 833183 - DNA, 20 bp, mouse
ggcgaggtaagagctggggt

SEQ ID NO: 833184 - DNA, 20 bp, mouse
gagaaagctctatccctgac

SEQ ID NO: 833185 - DNA, 20 bp, mouse
gggagggatggggcctgaca

SEQ ID NO: 833186 - DNA, 20 bp, mouse
gggccagcaggtctctatct

SEQ ID NO: 833187 - DNA, 20 bp, mouse
gtgggcggaacgggcgttgt

SEQ ID NO: 833188 - DNA, 20 bp, mouse
gcgccgcgacacggctgaat

SEQ ID NO: 833189 - DNA, 20 bp, mouse
gtggagcagcgcttctgttc

SEQ ID NO: 833190 - DNA, 20 bp, mouse
gtccgaagggcgccgcgaca

SEQ ID NO: 833191 - DNA, 20 bp, mouse
gtctctatcttggctccgaa

SEQ ID NO: 833192 - DNA, 20 bp, mouse
ggctctctaaggtcttattc

SEQ ID NO: 833193 - DNA, 20 bp, mouse
ggggcctttgtgggcggaac

SEQ ID NO: 833194 - DNA, 20 bp, mouse
gggtatctgtgcagtacgct

SEQ ID NO: 833195 - DNA, 20 bp, mouse
gcccacaaaggcccccagac

SEQ ID NO: 833196 - DNA, 20 bp, mouse
gggaaagtgagagcgcggga

SEQ ID NO: 833197 - DNA, 20 bp, mouse
ggggcgggaggaggctcccg

SEQ ID NO: 833198 - DNA, 20 bp, mouse
gatcggccggggtagcgggt

SEQ ID NO: 833199 - DNA, 20 bp, mouse
ggccggggtagcgggtgggt

SEQ ID NO: 833200 - DNA, 20 bp, mouse
ggagggacgaggggcgtgat

SEQ ID NO: 833201 - DNA, 20 bp, mouse
gtccctgcttccagctcccg

SEQ ID NO: 833202 - DNA, 20 bp, mouse
gcgcccgcctctctcccccg

SEQ ID NO: 833203 - DNA, 20 bp, mouse
gcgggaggaggctcccgcgg

SEQ ID NO: 833204 - DNA, 20 bp, mouse
ggggagccggcttaggggga

SEQ ID NO: 833205 - DNA, 20 bp, mouse
gtgcggggagccggcttagg

SEQ ID NO: 833206 - DNA, 20 bp, mouse
ggaccggattcgcagaggaa

SEQ ID NO: 833207 - DNA, 20 bp, mouse
gaggtctgaacaaaccgcta

SEQ ID NO: 833208 - DNA, 20 bp, mouse
ggagtagaggctatcaccaa

SEQ ID NO: 833209 - DNA, 20 bp, mouse
ggggctggatgtgctaagtc

SEQ ID NO: 833210 - DNA, 20 bp, mouse
ggagagctgcattgagtccc

SEQ ID NO: 833211 - DNA, 20 bp, mouse
gaagtgtggagttcaatgca

SEQ ID NO: 833212 - DNA, 20 bp, mouse
gggggcacgtaaatgctaag

SEQ ID NO: 833213 - DNA, 20 bp, mouse
ggaatggaccggattcgcag

SEQ ID NO: 833214 - DNA, 20 bp, mouse
gagcccttcctctgcgaatc

SEQ ID NO: 833215 - DNA, 20 bp, mouse
gtgctcacacactatagatg

SEQ ID NO: 833216 - DNA, 20 bp, mouse
gcagccgcgggaactgtccg

SEQ ID NO: 833217 - DNA, 20 bp, mouse
gtaccagcagcgaaaggcta

SEQ ID NO: 833218 - DNA, 20 bp, mouse
gtacactagacagactgcat

SEQ ID NO: 833219 - DNA, 20 bp, mouse
ggacccctgccaggtttcca

SEQ ID NO: 833220 - DNA, 20 bp, mouse
ggttcccgcggctgcaggat

SEQ ID NO: 833221 - DNA, 20 bp, mouse
ggtaccgcggacagttcccg

SEQ ID NO: 833222 - DNA, 20 bp, mouse
gcgagcgtggggcgcgcctg

SEQ ID NO: 833223 - DNA, 20 bp, mouse
gcgcaacgcgagagacccgc

SEQ ID NO: 833224 - DNA, 20 bp, mouse
gagtggagggctctactgtg

SEQ ID NO: 833225 - DNA, 20 bp, mouse
gactagacagactgcattgg

SEQ ID NO: 833226 - DNA, 20 bp, mouse
gccgtggcgccccacacttc

SEQ ID NO: 833227 - DNA, 20 bp, mouse
gggccggtacggccgatcat

SEQ ID NO: 833228 - DNA, 20 bp, mouse
gacgccctgcgattataaac

SEQ ID NO: 833229 - DNA, 20 bp, mouse
gcgcggggctgggcccatat

SEQ ID NO: 833230 - DNA, 20 bp, mouse
ggggcgcgaagcggctcttc

SEQ ID NO: 833231 - DNA, 20 bp, mouse
ggcgggccgggcggccggta

SEQ ID NO: 833232 - DNA, 20 bp, mouse
gaccgcgcgtacaccgggcg

SEQ ID NO: 833233 - DNA, 20 bp, mouse
gtgcagaagctgcccatgat

SEQ ID NO: 833234 - DNA, 20 bp, mouse
ggggcagcttctgcacgtag

SEQ ID NO: 833235 - DNA, 20 bp, mouse
gcgggctttcgtcaccctga

SEQ ID NO: 833236 - DNA, 20 bp, mouse
gcagccgccggctgcatctg

SEQ ID NO: 833237 - DNA, 20 bp, mouse
gagactgcccagaaagcgga

SEQ ID NO: 833238 - DNA, 20 bp, mouse
gcagaaagcggagggttcgt

SEQ ID NO: 833239 - DNA, 20 bp, mouse
gatcccactggggtagaagt

SEQ ID NO: 833240 - DNA, 20 bp, mouse
ggcaaactctccccagccgc

SEQ ID NO: 833241 - DNA, 20 bp, mouse
ggtagaagtgggattcctgc

SEQ ID NO: 833242 - DNA, 20 bp, mouse
gagacttctcgcgagatcta

SEQ ID NO: 833243 - DNA, 20 bp, mouse
gcaaggatgccatcggaccc

SEQ ID NO: 833244 - DNA, 20 bp, mouse
gctggcgggctactggagca

SEQ ID NO: 833245 - DNA, 20 bp, mouse
gctactgcaataacgaaagt

SEQ ID NO: 833246 - DNA, 20 bp, mouse
ggcaacaggggcaggttgcc

SEQ ID NO: 833247 - DNA, 20 bp, mouse
gaacgggcatcaggcaacag

SEQ ID NO: 833248 - DNA, 20 bp, mouse
ggctctcccgatagcagctc

SEQ ID NO: 833249 - DNA, 20 bp, mouse
gtgtgggcatgaggaatcaa

SEQ ID NO: 833250 - DNA, 20 bp, mouse
ggcggagccaatagctggga

SEQ ID NO: 833251 - DNA, 20 bp, mouse
gtcgctgccatgtttgtaat

SEQ ID NO: 833252 - DNA, 20 bp, mouse
gcacctgcccgagctgctat

SEQ ID NO: 833253 - DNA, 20 bp, mouse
ggggcaggtgaccgcgcctg

SEQ ID NO: 833254 - DNA, 20 bp, mouse
ggagaggagataagtacttc

SEQ ID NO: 833255 - DNA, 20 bp, mouse
ggtaatgggctatttccctt

SEQ ID NO: 833256 - DNA, 20 bp, mouse
gtatagcgtccgtttcacta

SEQ ID NO: 833257 - DNA, 20 bp, mouse
gccaatctaccatagtgaaa

SEQ ID NO: 833258 - DNA, 20 bp, mouse
gtgcggccttcagctatcag

SEQ ID NO: 833259 - DNA, 20 bp, mouse
gctgcaccactgatagctga

SEQ ID NO: 833260 - DNA, 20 bp, mouse
gcgaggccaccgaccaccga

SEQ ID NO: 833261 - DNA, 20 bp, mouse
gtggggtccgtacccttcgg

SEQ ID NO: 833262 - DNA, 20 bp, mouse
ggtccgtacccttcggtggt

SEQ ID NO: 833263 - DNA, 20 bp, mouse
gcaccgaccaccgaagggta

SEQ ID NO: 833264 - DNA, 20 bp, mouse
gtctcccgcagcactcgcgc

SEQ ID NO: 833265 - DNA, 20 bp, mouse
gagcagccatgatgagtgtc

SEQ ID NO: 833266 - DNA, 20 bp, mouse
gtacttccctcttcttcgga

SEQ ID NO: 833267 - DNA, 20 bp, mouse
gtgcggccttcagctatcag

SEQ ID NO: 833268 - DNA, 20 bp, mouse
gctgcaccactgatagctga

SEQ ID NO: 833269 - DNA, 20 bp, mouse
gcgaggccaccgaccacgga

SEQ ID NO: 833270 - DNA, 20 bp, mouse
gtggggtccgtacccttccg

SEQ ID NO: 833271 - DNA, 20 bp, mouse
ggtccgtacccttccgtggt

SEQ ID NO: 833272 - DNA, 20 bp, mouse
gtctcccgcagcactcgcgc

SEQ ID NO: 833273 - DNA, 20 bp, mouse
gcaccgaccacggaagggta

SEQ ID NO: 833274 - DNA, 20 bp, mouse
ggatgcgaggccaccgacca

SEQ ID NO: 833275 - DNA, 20 bp, mouse
ggtgtccggcgcgagtgctg

SEQ ID NO: 833276 - DNA, 20 bp, mouse
gtaggaagtagatcgggctg

SEQ ID NO: 833277 - DNA, 20 bp, mouse
gctgagttacacctatatac

SEQ ID NO: 833278 - DNA, 20 bp, mouse
gtaattctaaatatctattc

SEQ ID NO: 833279 - DNA, 20 bp, mouse
gactatagctgaccttagat

SEQ ID NO: 833280 - DNA, 20 bp, mouse
ggcaaagactggcaggaact

SEQ ID NO: 833281 - DNA, 20 bp, mouse
gtgaaaacgcaaagactggc

SEQ ID NO: 833282 - DNA, 20 bp, mouse
gggaatgaaaacgcaaagac

SEQ ID NO: 833283 - DNA, 20 bp, mouse
gtgagaacttttcactccta

SEQ ID NO: 833284 - DNA, 20 bp, mouse
gcttttcactcctagggcaa

SEQ ID NO: 833285 - DNA, 20 bp, mouse
gaatggtttaggaagtagat

SEQ ID NO: 833286 - DNA, 20 bp, mouse
gaaccaggcaggagcgggct

SEQ ID NO: 833287 - DNA, 20 bp, mouse
gggaactgcaagaaaatagt

SEQ ID NO: 833288 - DNA, 20 bp, mouse
ggagacgaaccaggcaggag

SEQ ID NO: 833289 - DNA, 20 bp, mouse
ggaggagttgcttgctccca

SEQ ID NO: 833290 - DNA, 20 bp, mouse
gctggggagcaggtcctcgc

SEQ ID NO: 833291 - DNA, 20 bp, mouse
gataaagagacgaaccaggc

SEQ ID NO: 833292 - DNA, 20 bp, mouse
gtctctttatagtcagggga

SEQ ID NO: 833293 - DNA, 20 bp, mouse
ggcctgccattctcagctgc

SEQ ID NO: 833294 - DNA, 20 bp, mouse
ggactataaagagacgaacc

SEQ ID NO: 833295 - DNA, 20 bp, mouse
gctcgactcggctaggtctg

SEQ ID NO: 833296 - DNA, 20 bp, mouse
gcggagcgggctgtaggacg

SEQ ID NO: 833297 - DNA, 20 bp, mouse
gcctacagcccgctccgctt

SEQ ID NO: 833298 - DNA, 20 bp, mouse
ggcccggtgacgtcatcacc

SEQ ID NO: 833299 - DNA, 20 bp, mouse
ggaggggcgtcggcaatcaa

SEQ ID NO: 833300 - DNA, 20 bp, mouse
gggggagccaatcgcctccg

SEQ ID NO: 833301 - DNA, 20 bp, mouse
gggctccccgagaggggcgt

SEQ ID NO: 833302 - DNA, 20 bp, mouse
gtcttcatcaccgtcttctc

SEQ ID NO: 833303 - DNA, 20 bp, mouse
ggattgccgacgcccctctc

SEQ ID NO: 833304 - DNA, 20 bp, mouse
gcaggttcccaaagcggagc

SEQ ID NO: 833305 - DNA, 20 bp, mouse
gggcgattggctccccgaga

SEQ ID NO: 833306 - DNA, 20 bp, mouse
gtggccgtggtgggccccca

SEQ ID NO: 833307 - DNA, 20 bp, mouse
ggggaagcttctgtggatga

SEQ ID NO: 833308 - DNA, 20 bp, mouse
gcccacagctgcccagaatc

SEQ ID NO: 833309 - DNA, 20 bp, mouse
gggtccgaaggaacctgagg

SEQ ID NO: 833310 - DNA, 20 bp, mouse
gcttccctgggggcccacca

SEQ ID NO: 833311 - DNA, 20 bp, mouse
gagcctggggctcagatcct

SEQ ID NO: 833312 - DNA, 20 bp, mouse
gtccacagaagcttccctgg

SEQ ID NO: 833313 - DNA, 20 bp, mouse
gggcaggcagaaagtgcatt

SEQ ID NO: 833314 - DNA, 20 bp, mouse
gcagaatcaggcgagctggt

SEQ ID NO: 833315 - DNA, 20 bp, mouse
gctctcacaaaggggacagg

SEQ ID NO: 833316 - DNA, 20 bp, mouse
gaagcaccacgcgcaatctc

SEQ ID NO: 833317 - DNA, 20 bp, mouse
gcaatctcgggtcaggagaa

SEQ ID NO: 833318 - DNA, 20 bp, mouse
gccacgcgcaatctcgggtc

SEQ ID NO: 833319 - DNA, 20 bp, mouse
gcactcgccgagccttaaag

SEQ ID NO: 833320 - DNA, 20 bp, mouse
gtggtgggtgggactggact

SEQ ID NO: 833321 - DNA, 20 bp, mouse
ggctcggcgagtgacctcag

SEQ ID NO: 833322 - DNA, 20 bp, mouse
gacgcaccgcgagagaccca

SEQ ID NO: 833323 - DNA, 20 bp, mouse
ggggactggactaggaaacc

SEQ ID NO: 833324 - DNA, 20 bp, mouse
ggatgcacagtctgacccgc

SEQ ID NO: 833325 - DNA, 20 bp, mouse
gaggctgctaggaatgaggt

SEQ ID NO: 833326 - DNA, 20 bp, mouse
ggcaggaaggagagtagcgg

SEQ ID NO: 833327 - DNA, 20 bp, mouse
ggtaacctaggttaccgaga

SEQ ID NO: 833328 - DNA, 20 bp, mouse
gtctaagtggttccctaaaa

SEQ ID NO: 833329 - DNA, 20 bp, mouse
gcattgtgattggtcagtta

SEQ ID NO: 833330 - DNA, 20 bp, mouse
gttaccgagagggcgtggca

SEQ ID NO: 833331 - DNA, 20 bp, mouse
gcaacgcaaagcattgtgat

SEQ ID NO: 833332 - DNA, 20 bp, mouse
ggagggcgtggctgtaacct

SEQ ID NO: 833333 - DNA, 20 bp, mouse
gtgtgattggtcagttacgg

SEQ ID NO: 833334 - DNA, 20 bp, mouse
ggagagtagcggcggatttc

SEQ ID NO: 833335 - DNA, 20 bp, mouse
gtctgggccgggtcttccgg

SEQ ID NO: 833336 - DNA, 20 bp, mouse
gccaccaccgcgagcctccc

SEQ ID NO: 833337 - DNA, 20 bp, mouse
gggaactccagggctcggag

SEQ ID NO: 833338 - DNA, 20 bp, mouse
ggagcggacccggaagttcc

SEQ ID NO: 833339 - DNA, 20 bp, mouse
gaactctacccggaacttcc

SEQ ID NO: 833340 - DNA, 20 bp, mouse
gtacctgccgcggggcagtc

SEQ ID NO: 833341 - DNA, 20 bp, mouse
ggggcgccgcctacctgccg

SEQ ID NO: 833342 - DNA, 20 bp, mouse
gcaggtaggcggcgcccggg

SEQ ID NO: 833343 - DNA, 20 bp, mouse
gactctctgtctcttcgaca

SEQ ID NO: 833344 - DNA, 20 bp, mouse
gaggagacgcgagtcctgag

SEQ ID NO: 833345 - DNA, 20 bp, mouse
gccatgggaagattccctaa

SEQ ID NO: 833346 - DNA, 20 bp, mouse
gaactcgcgtaccgcgctgg

SEQ ID NO: 833347 - DNA, 20 bp, mouse
gcagctggacgcggaaggca

SEQ ID NO: 833348 - DNA, 20 bp, mouse
gggacgcagctggacgcgga

SEQ ID NO: 833349 - DNA, 20 bp, mouse
ggccgcgcccggccaatcgc

SEQ ID NO: 833350 - DNA, 20 bp, mouse
gaggcccgaaggcctgcgat

SEQ ID NO: 833351 - DNA, 20 bp, mouse
ggccccgcgtcacagccaat

SEQ ID NO: 833352 - DNA, 20 bp, mouse
gcgccccccggcgccgcggt

SEQ ID NO: 833353 - DNA, 20 bp, mouse
ggctggacggggcagcacat

SEQ ID NO: 833354 - DNA, 20 bp, mouse
gccggccaatcgcaggcctt

SEQ ID NO: 833355 - DNA, 20 bp, mouse
gcctcagccaaccgcggcgc

SEQ ID NO: 833356 - DNA, 20 bp, mouse
ggccactgctagcgcggcgc

SEQ ID NO: 833357 - DNA, 20 bp, mouse
gagcgcggcgcgggtggcgt

SEQ ID NO: 833358 - DNA, 20 bp, mouse
gtgtgcccgcggtgtcccct

SEQ ID NO: 833359 - DNA, 20 bp, mouse
gggggcgccgcggccaccct

SEQ ID NO: 833360 - DNA, 20 bp, mouse
gcacctgcacctgcaccgag

SEQ ID NO: 833361 - DNA, 20 bp, mouse
gtgcaccgaggggacaccgc

SEQ ID NO: 833362 - DNA, 20 bp, mouse
gacggtgcccagggtggccg

SEQ ID NO: 833363 - DNA, 20 bp, mouse
ggagccgctgctggcctcgg

SEQ ID NO: 833364 - DNA, 20 bp, mouse
ggcaggtgcaggtgcgcgca

SEQ ID NO: 833365 - DNA, 20 bp, mouse
ggggcgcacggtgcccaggg

SEQ ID NO: 833366 - DNA, 20 bp, mouse
gtgcccgggcaagcgaacca

SEQ ID NO: 833367 - DNA, 20 bp, mouse
gactcccggggcagcggggt

SEQ ID NO: 833368 - DNA, 20 bp, mouse
gcccgggcagcgtacggcag

SEQ ID NO: 833369 - DNA, 20 bp, mouse
gtggggcagacttggagcag

SEQ ID NO: 833370 - DNA, 20 bp, mouse
gcagcggggtggggacgtaa

SEQ ID NO: 833371 - DNA, 20 bp, mouse
ggggcagcgtacggcagagg

SEQ ID NO: 833372 - DNA, 20 bp, mouse
gccacctagagggacccgga

SEQ ID NO: 833373 - DNA, 20 bp, mouse
gacggcgcgctccgccccct

SEQ ID NO: 833374 - DNA, 20 bp, mouse
ggctcggggggggggtccga

SEQ ID NO: 833375 - DNA, 20 bp, mouse
gagagaccagagcgactccc

SEQ ID NO: 833376 - DNA, 20 bp, mouse
gagaaagcaggacaacgcac

SEQ ID NO: 833377 - DNA, 20 bp, mouse
gagcaaggggttcacaagaa

SEQ ID NO: 833378 - DNA, 20 bp, mouse
gcttacttaggagaagaggt

SEQ ID NO: 833379 - DNA, 20 bp, mouse
gggtcccatcaattctatct

SEQ ID NO: 833380 - DNA, 20 bp, mouse
ggctccttacttaggagaag

SEQ ID NO: 833381 - DNA, 20 bp, mouse
gacctgacaggataaggata

SEQ ID NO: 833382 - DNA, 20 bp, mouse
gtctgaacttgggtctcttg

SEQ ID NO: 833383 - DNA, 20 bp, mouse
gaggataaggatatgggact

SEQ ID NO: 833384 - DNA, 20 bp, mouse
gcaaccagatgagaggagga

SEQ ID NO: 833385 - DNA, 20 bp, mouse
gaaacccttctctaacaatg

SEQ ID NO: 833386 - DNA, 20 bp, mouse
gcgcccgaacccaaccgaga

SEQ ID NO: 833387 - DNA, 20 bp, mouse
ggatcacgcccgaccaattc

SEQ ID NO: 833388 - DNA, 20 bp, mouse
ggtgtgagggcacgaagatc

SEQ ID NO: 833389 - DNA, 20 bp, mouse
gtacccaggcggtggaggtc

SEQ ID NO: 833390 - DNA, 20 bp, mouse
gaattcaggtatacaaagcc

SEQ ID NO: 833391 - DNA, 20 bp, mouse
gggtcgggcgtgatccgtct

SEQ ID NO: 833392 - DNA, 20 bp, mouse
gcaggcggtggaggtcgggg

SEQ ID NO: 833393 - DNA, 20 bp, mouse
gtggtggcccgcgtcacaat

SEQ ID NO: 833394 - DNA, 20 bp, mouse
gcgtcacaataggcagcaga

SEQ ID NO: 833395 - DNA, 20 bp, mouse
gggccaccaagttacccagg

SEQ ID NO: 833396 - DNA, 20 bp, mouse
gaaccccaaaacaaccgcct

SEQ ID NO: 833397 - DNA, 20 bp, mouse
gagctgcagtgtagcccagg

SEQ ID NO: 833398 - DNA, 20 bp, mouse
gagcccaggcggttgttttg

SEQ ID NO: 833399 - DNA, 20 bp, mouse
ggctgctgatcggctgatct

SEQ ID NO: 833400 - DNA, 20 bp, mouse
gaaagctggagtctgcaggg

SEQ ID NO: 833401 - DNA, 20 bp, mouse
gggcggggcgagcgcagagt

SEQ ID NO: 833402 - DNA, 20 bp, mouse
ggatcggctgatctaggtgg

SEQ ID NO: 833403 - DNA, 20 bp, mouse
gggatgaagcaacagtttag

SEQ ID NO: 833404 - DNA, 20 bp, mouse
gtcagccgatcagcagccag

SEQ ID NO: 833405 - DNA, 20 bp, mouse
gttgagctgcagtgtagccc

SEQ ID NO: 833406 - DNA, 20 bp, mouse
ggaagcagattgcggggaaa

SEQ ID NO: 833407 - DNA, 20 bp, mouse
gcccacccgtggagcaggcg

SEQ ID NO: 833408 - DNA, 20 bp, mouse
gctcctagcaacgccaatcc

SEQ ID NO: 833409 - DNA, 20 bp, mouse
gcaatcctggcagtgacgac

SEQ ID NO: 833410 - DNA, 20 bp, mouse
gcggacggaagcagattgcg

SEQ ID NO: 833411 - DNA, 20 bp, mouse
gggcagcgccggcagccaat

SEQ ID NO: 833412 - DNA, 20 bp, mouse
gctaggaggtgtggctccta

SEQ ID NO: 833413 - DNA, 20 bp, mouse
ggaggccccgcctgctccac

SEQ ID NO: 833414 - DNA, 20 bp, mouse
gtcctaggggcgcgggaggg

SEQ ID NO: 833415 - DNA, 20 bp, mouse
gggctcctaggggcgcggga

SEQ ID NO: 833416 - DNA, 20 bp, mouse
gccaggagcaagaatcggga

SEQ ID NO: 833417 - DNA, 20 bp, mouse
gagcgggaaagcggagggag

SEQ ID NO: 833418 - DNA, 20 bp, mouse
gtggtgcgggccactcagaa

SEQ ID NO: 833419 - DNA, 20 bp, mouse
gcgccgagcggctctcccag

SEQ ID NO: 833420 - DNA, 20 bp, mouse
ggcaggtgatcgccccctgg

SEQ ID NO: 833421 - DNA, 20 bp, mouse
gaaggcaggtgatcgccccc

SEQ ID NO: 833422 - DNA, 20 bp, mouse
ggctctgagaaccctgcgcg

SEQ ID NO: 833423 - DNA, 20 bp, mouse
ggagcaagaatcgggaaggc

SEQ ID NO: 833424 - DNA, 20 bp, mouse
gccaagagcgggaaagcgga

SEQ ID NO: 833425 - DNA, 20 bp, mouse
gagagccgctcggcggaccg

SEQ ID NO: 833426 - DNA, 20 bp, mouse
ggggaggaagaggacaacaa

SEQ ID NO: 833427 - DNA, 20 bp, mouse
gaggaagaggacaacaacgg

SEQ ID NO: 833428 - DNA, 20 bp, mouse
gggtctctaggcagagcggg

SEQ ID NO: 833429 - DNA, 20 bp, mouse
gacagcaagtgctaggaacg

SEQ ID NO: 833430 - DNA, 20 bp, mouse
gaatcagattcaagagaggg

SEQ ID NO: 833431 - DNA, 20 bp, mouse
gcaggggcggggcgaatcag

SEQ ID NO: 833432 - DNA, 20 bp, mouse
gtctaggcagagcgggtgga

SEQ ID NO: 833433 - DNA, 20 bp, mouse
gaaaaagcgaccttgtctga

SEQ ID NO: 833434 - DNA, 20 bp, mouse
gtctaggtctctaggcagag

SEQ ID NO: 833435 - DNA, 20 bp, mouse
gggagccagagaggtgcgga

SEQ ID NO: 833436 - DNA, 20 bp, mouse
gctagcggagagggacgaag

SEQ ID NO: 833437 - DNA, 20 bp, mouse
gccggagaggcagacgccgg

SEQ ID NO: 833438 - DNA, 20 bp, mouse
gagggccccgcccccgaggt

SEQ ID NO: 833439 - DNA, 20 bp, mouse
gacgaaggggaggaggttaa

SEQ ID NO: 833440 - DNA, 20 bp, mouse
ggcgcgcagtgctgctctaa

SEQ ID NO: 833441 - DNA, 20 bp, mouse
gcgacccgcccggggattcc

SEQ ID NO: 833442 - DNA, 20 bp, mouse
gcctctccggcgctgaggag

SEQ ID NO: 833443 - DNA, 20 bp, mouse
ggggtctagccgtcagctag

SEQ ID NO: 833444 - DNA, 20 bp, mouse
gggccctgtcggtgacacgt

SEQ ID NO: 833445 - DNA, 20 bp, mouse
gtagcccgaggcggctccga

SEQ ID NO: 833446 - DNA, 20 bp, mouse
ggaggatgacatcacggggc

SEQ ID NO: 833447 - DNA, 20 bp, mouse
gacgcccatcaagactaaga

SEQ ID NO: 833448 - DNA, 20 bp, mouse
gggaaggtctctgaatgcta

SEQ ID NO: 833449 - DNA, 20 bp, mouse
ggctgggtgggggtgttcat

SEQ ID NO: 833450 - DNA, 20 bp, mouse
gagcacccgctggtccaact

SEQ ID NO: 833451 - DNA, 20 bp, mouse
gggagacagggagtgtgtat

SEQ ID NO: 833452 - DNA, 20 bp, mouse
gtctgtctgtgggggaaccc

SEQ ID NO: 833453 - DNA, 20 bp, mouse
gccatcaagactaagacgga

SEQ ID NO: 833454 - DNA, 20 bp, mouse
gttagagaagtgggtagcct

SEQ ID NO: 833455 - DNA, 20 bp, mouse
gctcttcattgctatggtta

SEQ ID NO: 833456 - DNA, 20 bp, mouse
ggagccgggcccagaatcta

SEQ ID NO: 833457 - DNA, 20 bp, mouse
gcgctcgggcgggacatggc

SEQ ID NO: 833458 - DNA, 20 bp, mouse
gcccgctcggctgctgacac

SEQ ID NO: 833459 - DNA, 20 bp, mouse
gtcccgcccgagcgcccgct

SEQ ID NO: 833460 - DNA, 20 bp, mouse
gcacaggcgccggatgtagc

SEQ ID NO: 833461 - DNA, 20 bp, mouse
gcggcgccccgccgcgggtc

SEQ ID NO: 833462 - DNA, 20 bp, mouse
gcttaggcgcggggcagtgt

SEQ ID NO: 833463 - DNA, 20 bp, mouse
gcagcggctgcccactgcta

SEQ ID NO: 833464 - DNA, 20 bp, mouse
gtgtgcggtcggtggagcag

SEQ ID NO: 833465 - DNA, 20 bp, mouse
gccgccccccgcggccgcgt

SEQ ID NO: 833466 - DNA, 20 bp, mouse
gcgcccgccaacaccgtcgg

SEQ ID NO: 833467 - DNA, 20 bp, mouse
gggcggccagggtttcccag

SEQ ID NO: 833468 - DNA, 20 bp, mouse
gggacgcccgccaacaccgt

SEQ ID NO: 833469 - DNA, 20 bp, mouse
gcaccacaagctgcagacga

SEQ ID NO: 833470 - DNA, 20 bp, mouse
gggcggggcctgttgtcaga

SEQ ID NO: 833471 - DNA, 20 bp, mouse
ggggaaaccctggccgccga

SEQ ID NO: 833472 - DNA, 20 bp, mouse
gtagggaggcgggtcaaagg

SEQ ID NO: 833473 - DNA, 20 bp, mouse
gagctagggaggcgggtcaa

SEQ ID NO: 833474 - DNA, 20 bp, mouse
gccctggccgccgacggtgt

SEQ ID NO: 833475 - DNA, 20 bp, mouse
gtggccgccgacggtgttgg

SEQ ID NO: 833476 - DNA, 20 bp, mouse
gtaggagtgcagtatctctt

SEQ ID NO: 833477 - DNA, 20 bp, mouse
gagggtcggggtccccctgg

SEQ ID NO: 833478 - DNA, 20 bp, mouse
gtgggaagggttctgggcat

SEQ ID NO: 833479 - DNA, 20 bp, mouse
gccagtagagcagactggtt

SEQ ID NO: 833480 - DNA, 20 bp, mouse
gactggttgggaagggttct

SEQ ID NO: 833481 - DNA, 20 bp, mouse
gagcagcttaaaccctctga

SEQ ID NO: 833482 - DNA, 20 bp, mouse
gcgaggggcgtggaaccgag

SEQ ID NO: 833483 - DNA, 20 bp, mouse
gtagagcagactggttggga

SEQ ID NO: 833484 - DNA, 20 bp, mouse
gcactcgtgcagccgccagg

SEQ ID NO: 833485 - DNA, 20 bp, mouse
gctgggcatggggttgtgag

SEQ ID NO: 833486 - DNA, 20 bp, mouse
gcctccgccggccctcgctg

SEQ ID NO: 833487 - DNA, 20 bp, mouse
gccccgaagtaaccagggga

SEQ ID NO: 833488 - DNA, 20 bp, mouse
ggtaaagcgcagtaaggggg

SEQ ID NO: 833489 - DNA, 20 bp, mouse
gaccccggccgcgatcgcaa

SEQ ID NO: 833490 - DNA, 20 bp, mouse
gtcggggcggccacgtgcgg

SEQ ID NO: 833491 - DNA, 20 bp, mouse
ggggtggggtcgagctcggg

SEQ ID NO: 833492 - DNA, 20 bp, mouse
ggccgccccgaagtaaccag

SEQ ID NO: 833493 - DNA, 20 bp, mouse
gcgggccccccttgcgatcg

SEQ ID NO: 833494 - DNA, 20 bp, mouse
gggggtactcggatcgcccg

SEQ ID NO: 833495 - DNA, 20 bp, mouse
gggtatgtaaagcgcagtaa

SEQ ID NO: 833496 - DNA, 20 bp, mouse
ggggacaagtcgctgtcgaa

SEQ ID NO: 833497 - DNA, 20 bp, mouse
gttcccaagaggggcaccag

SEQ ID NO: 833498 - DNA, 20 bp, mouse
gccaagaggggcaccagggg

SEQ ID NO: 833499 - DNA, 20 bp, mouse
gtcgctgtcgaagggacgga

SEQ ID NO: 833500 - DNA, 20 bp, mouse
gagaaccaagctgtcagctg

SEQ ID NO: 833501 - DNA, 20 bp, mouse
ggtcggggcgcgatcgtgta

SEQ ID NO: 833502 - DNA, 20 bp, mouse
gggcgcgatcgtgtaaggca

SEQ ID NO: 833503 - DNA, 20 bp, mouse
gagaccggagccatgacaca

SEQ ID NO: 833504 - DNA, 20 bp, mouse
gggtgctcagacaggtagtt

SEQ ID NO: 833505 - DNA, 20 bp, mouse
gcaagtcgctgtcgaaggga

SEQ ID NO: 833506 - DNA, 20 bp, mouse
gctacggaagccctcggcac

SEQ ID NO: 833507 - DNA, 20 bp, mouse
gcgggagcgcgccgagtcaa

SEQ ID NO: 833508 - DNA, 20 bp, mouse
ggcgtccgagccagtgccga

SEQ ID NO: 833509 - DNA, 20 bp, mouse
ggcgcggggcgagcctgagt

SEQ ID NO: 833510 - DNA, 20 bp, mouse
gtgagtgggcggggcgccta

SEQ ID NO: 833511 - DNA, 20 bp, mouse
gtcaaggggcgggctcgcgc

SEQ ID NO: 833512 - DNA, 20 bp, mouse
gagcgcgccgagtcaagggg

SEQ ID NO: 833513 - DNA, 20 bp, mouse
ggggcgcctacggaagccct

SEQ ID NO: 833514 - DNA, 20 bp, mouse
ggcgagcccgccccttgact

SEQ ID NO: 833515 - DNA, 20 bp, mouse
ggctcgccccgcgccgcgat

SEQ ID NO: 833516 - DNA, 20 bp, mouse
gcctgtcagcagtgtgtctg

SEQ ID NO: 833517 - DNA, 20 bp, mouse
gaagacgaccagtgtcgcta

SEQ ID NO: 833518 - DNA, 20 bp, mouse
gtcacccggcttgtacaaag

SEQ ID NO: 833519 - DNA, 20 bp, mouse
gtctatacccaggattcttc

SEQ ID NO: 833520 - DNA, 20 bp, mouse
gctagcaccacctctgcatc

SEQ ID NO: 833521 - DNA, 20 bp, mouse
gtggctattggcattagagt

SEQ ID NO: 833522 - DNA, 20 bp, mouse
gacaactcttccagatgcag

SEQ ID NO: 833523 - DNA, 20 bp, mouse
ggactgtgctgatgtgagtc

SEQ ID NO: 833524 - DNA, 20 bp, mouse
gatgccaatagccattgccc

SEQ ID NO: 833525 - DNA, 20 bp, mouse
gattgaaaggagggaatgag

SEQ ID NO: 833526 - DNA, 20 bp, mouse
ggtcctgggctgtaccagtc

SEQ ID NO: 833527 - DNA, 20 bp, mouse
gggtacagcccaggacgagg

SEQ ID NO: 833528 - DNA, 20 bp, mouse
gtgggcccaagcggattcag

SEQ ID NO: 833529 - DNA, 20 bp, mouse
gagggcgcgaagtccggtgg

SEQ ID NO: 833530 - DNA, 20 bp, mouse
gcatccgagggcgcgaagtc

SEQ ID NO: 833531 - DNA, 20 bp, mouse
ggcaacctagccgccggcgc

SEQ ID NO: 833532 - DNA, 20 bp, mouse
gagcctctccgcctcgtcct

SEQ ID NO: 833533 - DNA, 20 bp, mouse
gccgccggcgccgggcctca

SEQ ID NO: 833534 - DNA, 20 bp, mouse
gtggtgaggctcgggcgcta

SEQ ID NO: 833535 - DNA, 20 bp, mouse
ggcagggagggcactgatca

SEQ ID NO: 833536 - DNA, 20 bp, mouse
gaggcctggggagacttcag

SEQ ID NO: 833537 - DNA, 20 bp, mouse
gcatccctgactattcctat

SEQ ID NO: 833538 - DNA, 20 bp, mouse
gtgtcccataggaatagtca

SEQ ID NO: 833539 - DNA, 20 bp, mouse
gcgggcaggcagaatcctca

SEQ ID NO: 833540 - DNA, 20 bp, mouse
gtgtgctaggtcccggacca

SEQ ID NO: 833541 - DNA, 20 bp, mouse
gtcctatgggacaggaagat

SEQ ID NO: 833542 - DNA, 20 bp, mouse
gcacagagccagacactaac

SEQ ID NO: 833543 - DNA, 20 bp, mouse
gagcacatcctgttagtgtc

SEQ ID NO: 833544 - DNA, 20 bp, mouse
gggacctagcacagctggct

SEQ ID NO: 833545 - DNA, 20 bp, mouse
gcacagctggctaggtttga

SEQ ID NO: 833546 - DNA, 20 bp, mouse
ggcgcctgagcggagtgaac

SEQ ID NO: 833547 - DNA, 20 bp, mouse
gcctaagtgggagagtccag

SEQ ID NO: 833548 - DNA, 20 bp, mouse
gcaactgggcaatccctaag

SEQ ID NO: 833549 - DNA, 20 bp, mouse
gaacgggcgtggcttatggg

SEQ ID NO: 833550 - DNA, 20 bp, mouse
ggtggtatgctgtagtaggt

SEQ ID NO: 833551 - DNA, 20 bp, mouse
gaatgagctccgcgcctgag

SEQ ID NO: 833552 - DNA, 20 bp, mouse
gttggcttgcgggaatcaac

SEQ ID NO: 833553 - DNA, 20 bp, mouse
gacgcccgttcactccgctc

SEQ ID NO: 833554 - DNA, 20 bp, mouse
gtccaacgatggtgtcctca

SEQ ID NO: 833555 - DNA, 20 bp, mouse
gtgcgcatcttcggtgagac

SEQ ID NO: 833556 - DNA, 20 bp, mouse
gagtcggagcgcccagtaag

SEQ ID NO: 833557 - DNA, 20 bp, mouse
gggagagcttggtacacaaa

SEQ ID NO: 833558 - DNA, 20 bp, mouse
gtgagtgcagcatggcacaa

SEQ ID NO: 833559 - DNA, 20 bp, mouse
ggagcgcccagtaaggggag

SEQ ID NO: 833560 - DNA, 20 bp, mouse
gctaggtgccgggagcggtg

SEQ ID NO: 833561 - DNA, 20 bp, mouse
gtagttctaggtgccgggag

SEQ ID NO: 833562 - DNA, 20 bp, mouse
gcgcccaagaccaggcgtgg

SEQ ID NO: 833563 - DNA, 20 bp, mouse
gctattgcttgcctctctag

SEQ ID NO: 833564 - DNA, 20 bp, mouse
gggagtgcctgagtgcagca

SEQ ID NO: 833565 - DNA, 20 bp, mouse
gcagtaaggggagaggaaac

SEQ ID NO: 833566 - DNA, 20 bp, mouse
gagtttaaggtcagaaccca

SEQ ID NO: 833567 - DNA, 20 bp, mouse
gggagtatgtgaccacgaaa

SEQ ID NO: 833568 - DNA, 20 bp, mouse
gtgaccacgaaagggcatcc

SEQ ID NO: 833569 - DNA, 20 bp, mouse
gaaaaccctcacatgttccc

SEQ ID NO: 833570 - DNA, 20 bp, mouse
gacccagggactgtttgtta

SEQ ID NO: 833571 - DNA, 20 bp, mouse
gctgcatgctcacaggtact

SEQ ID NO: 833572 - DNA, 20 bp, mouse
gctgcagtgtgcattaatga

SEQ ID NO: 833573 - DNA, 20 bp, mouse
ggccttaacaaacagtccct

SEQ ID NO: 833574 - DNA, 20 bp, mouse
gcaagtgcatatttaattcc

SEQ ID NO: 833575 - DNA, 20 bp, mouse
gtaattccagggaacatgtg

SEQ ID NO: 833576 - DNA, 20 bp, mouse
gggagacggcagaactgcga

SEQ ID NO: 833577 - DNA, 20 bp, mouse
ggacggcagaactgcgatgg

SEQ ID NO: 833578 - DNA, 20 bp, mouse
gcccagaaaaccttgcgtgg

SEQ ID NO: 833579 - DNA, 20 bp, mouse
ggcggactcgctgcctctgg

SEQ ID NO: 833580 - DNA, 20 bp, mouse
gaggaagcgagcggtccttc

SEQ ID NO: 833581 - DNA, 20 bp, mouse
ggccccgccccctgagtcgg

SEQ ID NO: 833582 - DNA, 20 bp, mouse
gccaaagctcgggaccccga

SEQ ID NO: 833583 - DNA, 20 bp, mouse
gatggcggactcgctgcctc

SEQ ID NO: 833584 - DNA, 20 bp, mouse
ggtccccgaccaaggcctga

SEQ ID NO: 833585 - DNA, 20 bp, mouse
gcggggcctgtccccgacca

SEQ ID NO: 833586 - DNA, 20 bp, mouse
gtcttctcgcgagagggaga

SEQ ID NO: 833587 - DNA, 20 bp, mouse
ggttgccaggggaacgccct

SEQ ID NO: 833588 - DNA, 20 bp, mouse
gaaatccgagggcgttcccc

SEQ ID NO: 833589 - DNA, 20 bp, mouse
gcgcagaggcaagactaagg

SEQ ID NO: 833590 - DNA, 20 bp, mouse
ggttcccctggcaacgatcg

SEQ ID NO: 833591 - DNA, 20 bp, mouse
gtccctctcgcgagaagaga

SEQ ID NO: 833592 - DNA, 20 bp, mouse
gcaagccgggctacagttac

SEQ ID NO: 833593 - DNA, 20 bp, mouse
ggagccgcgatcgttgccag

SEQ ID NO: 833594 - DNA, 20 bp, mouse
ggtaggaggcacaaatccga

SEQ ID NO: 833595 - DNA, 20 bp, mouse
gccccctacggctaattggt

SEQ ID NO: 833596 - DNA, 20 bp, mouse
gcctgagtcaggggatatta

SEQ ID NO: 833597 - DNA, 20 bp, mouse
gtggagcaggtaaaggggac

SEQ ID NO: 833598 - DNA, 20 bp, mouse
gactgtgaggcagagagtgt

SEQ ID NO: 833599 - DNA, 20 bp, mouse
gaatcctgggacagaaagct

SEQ ID NO: 833600 - DNA, 20 bp, mouse
gggacagggttggtaaaccc

SEQ ID NO: 833601 - DNA, 20 bp, mouse
gctggccagacctgagtcag

SEQ ID NO: 833602 - DNA, 20 bp, mouse
gctgcaattccaggaatcct

SEQ ID NO: 833603 - DNA, 20 bp, mouse
gatatcccctgactcaggtc

SEQ ID NO: 833604 - DNA, 20 bp, mouse
gaaggtgctgacctcacagt

SEQ ID NO: 833605 - DNA, 20 bp, mouse
gaggactgcagatctctaag

SEQ ID NO: 833606 - DNA, 20 bp, mouse
gaagccagtgagactcgggg

SEQ ID NO: 833607 - DNA, 20 bp, mouse
gcccagtccaacaggagcga

SEQ ID NO: 833608 - DNA, 20 bp, mouse
ggaattagcccacggaaaga

SEQ ID NO: 833609 - DNA, 20 bp, mouse
gcgagtctcactggcttcat

SEQ ID NO: 833610 - DNA, 20 bp, mouse
gtgcaggatgcgccagcaga

SEQ ID NO: 833611 - DNA, 20 bp, mouse
gttagcccacggaaagaagg

SEQ ID NO: 833612 - DNA, 20 bp, mouse
ggacgcttggatacccagtt

SEQ ID NO: 833613 - DNA, 20 bp, mouse
gttcccatggcttctagctg

SEQ ID NO: 833614 - DNA, 20 bp, mouse
gaagcctcagctagaagcca

SEQ ID NO: 833615 - DNA, 20 bp, mouse
gttccgtgggctaattccca

SEQ ID NO: 833616 - DNA, 20 bp, mouse
gttccaccaaggtaagtgga

SEQ ID NO: 833617 - DNA, 20 bp, mouse
gaaggagtgaactctgactg

SEQ ID NO: 833618 - DNA, 20 bp, mouse
gctggcttaatcagactcaa

SEQ ID NO: 833619 - DNA, 20 bp, mouse
ggcaaatgaaggaatcaagg

SEQ ID NO: 833620 - DNA, 20 bp, mouse
gtctgctgtaaccaccaggc

SEQ ID NO: 833621 - DNA, 20 bp, mouse
gggcgggagatttctcattc

SEQ ID NO: 833622 - DNA, 20 bp, mouse
gctccttccacttaccttgg

SEQ ID NO: 833623 - DNA, 20 bp, mouse
gaaggtctgcgaccttgcta

SEQ ID NO: 833624 - DNA, 20 bp, mouse
gtttcttagagactgtagct

SEQ ID NO: 833625 - DNA, 20 bp, mouse
ggtctgattaagccaggaag

SEQ ID NO: 833626 - DNA, 20 bp, mouse
gcccccagccacagttacag

SEQ ID NO: 833627 - DNA, 20 bp, mouse
gcaatgggaactcttgtctc

SEQ ID NO: 833628 - DNA, 20 bp, mouse
gaacagcaagtgcaggtcta

SEQ ID NO: 833629 - DNA, 20 bp, mouse
ggcctctgtaactgtggctg

SEQ ID NO: 833630 - DNA, 20 bp, mouse
ggagttcccattgaggaaga

SEQ ID NO: 833631 - DNA, 20 bp, mouse
gcgcctccctcttcctcaat

SEQ ID NO: 833632 - DNA, 20 bp, mouse
gctgaagcaacagcaagtgc

SEQ ID NO: 833633 - DNA, 20 bp, mouse
gagggccttgaggaatgcat

SEQ ID NO: 833634 - DNA, 20 bp, mouse
gggaagtgattgcatgacta

SEQ ID NO: 833635 - DNA, 20 bp, mouse
gctgctgatgagacacttta

SEQ ID NO: 833636 - DNA, 20 bp, mouse
gagcgcctggggagtgatgg

SEQ ID NO: 833637 - DNA, 20 bp, mouse
ggagcccgcccgcaggtgca

SEQ ID NO: 833638 - DNA, 20 bp, mouse
ggcagggcgagaaaagtctg

SEQ ID NO: 833639 - DNA, 20 bp, mouse
gctctgacccgcatggaaat

SEQ ID NO: 833640 - DNA, 20 bp, mouse
gctaccctgcacctgcgggc

SEQ ID NO: 833641 - DNA, 20 bp, mouse
ggccgccgccatcactcccc

SEQ ID NO: 833642 - DNA, 20 bp, mouse
gggctcgcctctgacccgca

SEQ ID NO: 833643 - DNA, 20 bp, mouse
ggagtgggacgatgcagact

SEQ ID NO: 833644 - DNA, 20 bp, mouse
gtgggacgatgcagacttgg

SEQ ID NO: 833645 - DNA, 20 bp, mouse
ggcgccccaggggcggaacc

SEQ ID NO: 833646 - DNA, 20 bp, mouse
ggggcgcagcggatcggagt

SEQ ID NO: 833647 - DNA, 20 bp, mouse
ggagcctgggcgcagcggat

SEQ ID NO: 833648 - DNA, 20 bp, mouse
gcggtgcaagtgatgtaagg

SEQ ID NO: 833649 - DNA, 20 bp, mouse
ggggagggaggactccgtcc

SEQ ID NO: 833650 - DNA, 20 bp, mouse
ggcgcggtgcaagtgatgta

SEQ ID NO: 833651 - DNA, 20 bp, mouse
gagtgggcgcgcggcgctgc

SEQ ID NO: 833652 - DNA, 20 bp, mouse
gagctctagaagcggagcct

SEQ ID NO: 833653 - DNA, 20 bp, mouse
gccctcctgtgcagtgtcgg

SEQ ID NO: 833654 - DNA, 20 bp, mouse
gtctggctacctactcgcag

SEQ ID NO: 833655 - DNA, 20 bp, mouse
gaacagagatggacgcgcgg

SEQ ID NO: 833656 - DNA, 20 bp, mouse
gaaccacctacagtggtcta

SEQ ID NO: 833657 - DNA, 20 bp, mouse
gaggatggggttttaaacga

SEQ ID NO: 833658 - DNA, 20 bp, mouse
ggaccactgtaggtggttga

SEQ ID NO: 833659 - DNA, 20 bp, mouse
gccccctagaccactgtagg

SEQ ID NO: 833660 - DNA, 20 bp, mouse
ggacctacgccatgacgccg

SEQ ID NO: 833661 - DNA, 20 bp, mouse
gactgtaggtggttgacggc

SEQ ID NO: 833662 - DNA, 20 bp, mouse
gctggcgctgttctgtgcat

SEQ ID NO: 833663 - DNA, 20 bp, mouse
gtcatggcgtaggtcgttag

SEQ ID NO: 833664 - DNA, 20 bp, mouse
ggcagtcagtcaacaaataa

SEQ ID NO: 833665 - DNA, 20 bp, mouse
ggagcggccagaagaccggg

SEQ ID NO: 833666 - DNA, 20 bp, mouse
ggctgggagcgggtgaccgg

SEQ ID NO: 833667 - DNA, 20 bp, mouse
gggagtgcccacatccaaga

SEQ ID NO: 833668 - DNA, 20 bp, mouse
gcaacaccgttgccattggt

SEQ ID NO: 833669 - DNA, 20 bp, mouse
gaaggcccgcggcaacgtca

SEQ ID NO: 833670 - DNA, 20 bp, mouse
gaatggcaacggtgttgggc

SEQ ID NO: 833671 - DNA, 20 bp, mouse
gggggcgccatcttggatgt

SEQ ID NO: 833672 - DNA, 20 bp, mouse
gtggtcggtgggtcacgggg

SEQ ID NO: 833673 - DNA, 20 bp, mouse
gtgggctggccctcagattg

SEQ ID NO: 833674 - DNA, 20 bp, mouse
gcaggacgctgaggggagtg

SEQ ID NO: 833675 - DNA, 20 bp, mouse
gcggggaggcggggcttaga

SEQ ID NO: 833676 - DNA, 20 bp, mouse
gaacgcaaagcgtggtgggt

SEQ ID NO: 833677 - DNA, 20 bp, mouse
ggaccaatgggaggacgtaa

SEQ ID NO: 833678 - DNA, 20 bp, mouse
gcaggcaacgcaaagcgtgg

SEQ ID NO: 833679 - DNA, 20 bp, mouse
gccgccctttcagcacttaa

SEQ ID NO: 833680 - DNA, 20 bp, mouse
gcaattcaggagggattcta

SEQ ID NO: 833681 - DNA, 20 bp, mouse
gacagtacatatagaccaat

SEQ ID NO: 833682 - DNA, 20 bp, mouse
ggacgcccttaagtgctgaa

SEQ ID NO: 833683 - DNA, 20 bp, mouse
gcgtcctcaatagctgacgt

SEQ ID NO: 833684 - DNA, 20 bp, mouse
gttggacgaatcacaagtag

SEQ ID NO: 833685 - DNA, 20 bp, mouse
gattgtggggacaatcaaat

SEQ ID NO: 833686 - DNA, 20 bp, mouse
gcaagtggagggagtaactt

SEQ ID NO: 833687 - DNA, 20 bp, mouse
ggaccctgagatgtccaaaa

SEQ ID NO: 833688 - DNA, 20 bp, mouse
gcctcctgagagagcacagg

SEQ ID NO: 833689 - DNA, 20 bp, mouse
gcatgcgcgtctgaatggac

SEQ ID NO: 833690 - DNA, 20 bp, mouse
gacccaatgggccaagtgga

SEQ ID NO: 833691 - DNA, 20 bp, mouse
gcatgcgcggtgaccacggt

SEQ ID NO: 833692 - DNA, 20 bp, mouse
gcgtctgaatggactggggc

SEQ ID NO: 833693 - DNA, 20 bp, mouse
gaagccacccatgacgtcac

SEQ ID NO: 833694 - DNA, 20 bp, mouse
gcaaaagaaaagtcacccaa

SEQ ID NO: 833695 - DNA, 20 bp, mouse
gggcacggagccaggaactc

SEQ ID NO: 833696 - DNA, 20 bp, mouse
gagcgggagcggggatacaa

SEQ ID NO: 833697 - DNA, 20 bp, mouse
ggggcggggcgtagtaggtg

SEQ ID NO: 833698 - DNA, 20 bp, mouse
ggggcggtacccaggagggg

SEQ ID NO: 833699 - DNA, 20 bp, mouse
gaggaggggcggggcgtagt

SEQ ID NO: 833700 - DNA, 20 bp, mouse
gctctggccacgcccctctg

SEQ ID NO: 833701 - DNA, 20 bp, mouse
gtagcggggcggtacccagg

SEQ ID NO: 833702 - DNA, 20 bp, mouse
gggctcagacagcgggagcg

SEQ ID NO: 833703 - DNA, 20 bp, mouse
gagtggataaagtgtatcat

SEQ ID NO: 833704 - DNA, 20 bp, mouse
gcgaggctgggctagcgggg

SEQ ID NO: 833705 - DNA, 20 bp, mouse
ggtcttgcggcgctctctag

SEQ ID NO: 833706 - DNA, 20 bp, mouse
ggggctccacccctgtagag

SEQ ID NO: 833707 - DNA, 20 bp, mouse
gctatgtgatgagtgggaag

SEQ ID NO: 833708 - DNA, 20 bp, mouse
ggctaaggcggagcttaaga

SEQ ID NO: 833709 - DNA, 20 bp, mouse
ggcgtggtctatgtgatgag

SEQ ID NO: 833710 - DNA, 20 bp, mouse
gaggtgaaccgggagacgag

SEQ ID NO: 833711 - DNA, 20 bp, mouse
ggaaccgggagacgaggggc

SEQ ID NO: 833712 - DNA, 20 bp, mouse
ggagtcctgtggacgatgat

SEQ ID NO: 833713 - DNA, 20 bp, mouse
gcctagcccctaggtgaacc

SEQ ID NO: 833714 - DNA, 20 bp, mouse
gaggctccacccctctacag

SEQ ID NO: 833715 - DNA, 20 bp, mouse
gcctgaagggcggacttaag

SEQ ID NO: 833716 - DNA, 20 bp, mouse
ggggaggcggagtgtcctct

SEQ ID NO: 833717 - DNA, 20 bp, mouse
gtcccggaagtgatgacaca

SEQ ID NO: 833718 - DNA, 20 bp, mouse
gcggaaccgcggttggttgt

SEQ ID NO: 833719 - DNA, 20 bp, mouse
ggcggcggctgtaacagaag

SEQ ID NO: 833720 - DNA, 20 bp, mouse
gcaaggctccaattccccgg

SEQ ID NO: 833721 - DNA, 20 bp, mouse
gatgacacaggggcgagcgg

SEQ ID NO: 833722 - DNA, 20 bp, mouse
gagccgggcccagaaggaca

SEQ ID NO: 833723 - DNA, 20 bp, mouse
gcgggatggcggaagcggaa

SEQ ID NO: 833724 - DNA, 20 bp, mouse
ggcgcgcgggatggcggaag

SEQ ID NO: 833725 - DNA, 20 bp, mouse
ggcccctgtgtcatcacttc

SEQ ID NO: 833726 - DNA, 20 bp, mouse
gtaaactacccgaaggactt

SEQ ID NO: 833727 - DNA, 20 bp, mouse
gcaccctgtaactgtgactg

SEQ ID NO: 833728 - DNA, 20 bp, mouse
gctgacactaaactacccga

SEQ ID NO: 833729 - DNA, 20 bp, mouse
ggctctgtgtacttaacccc

SEQ ID NO: 833730 - DNA, 20 bp, mouse
gttccagaaggtaggtgagg

SEQ ID NO: 833731 - DNA, 20 bp, mouse
gtgggcaagttcgccgtgat

SEQ ID NO: 833732 - DNA, 20 bp, mouse
gtccctcaatgcaggagggg

SEQ ID NO: 833733 - DNA, 20 bp, mouse
ggcccctggataatattgtc

SEQ ID NO: 833734 - DNA, 20 bp, mouse
gcccacccctcctgcattga

SEQ ID NO: 833735 - DNA, 20 bp, mouse
gcctcctcagtcacagttac

SEQ ID NO: 833736 - DNA, 20 bp, mouse
gtctctctcgggagatggag

SEQ ID NO: 833737 - DNA, 20 bp, mouse
gccctaggtaccaaggtcaa

SEQ ID NO: 833738 - DNA, 20 bp, mouse
gcatcggaatacttgtgtag

SEQ ID NO: 833739 - DNA, 20 bp, mouse
gttaacgggcttaactgaag

SEQ ID NO: 833740 - DNA, 20 bp, mouse
gtccagggaaccacctatgt

SEQ ID NO: 833741 - DNA, 20 bp, mouse
gtccaatgccctaggtacca

SEQ ID NO: 833742 - DNA, 20 bp, mouse
gtatggaattctctgtctgt

SEQ ID NO: 833743 - DNA, 20 bp, mouse
gcactcatccaaacgacctt

SEQ ID NO: 833744 - DNA, 20 bp, mouse
gtcagagcaacaaactacta

SEQ ID NO: 833745 - DNA, 20 bp, mouse
gcacagtggagattgagaaa

SEQ ID NO: 833746 - DNA, 20 bp, mouse
gctcccgcgccgggtctcac

SEQ ID NO: 833747 - DNA, 20 bp, mouse
gtggccaaaggggacccggg

SEQ ID NO: 833748 - DNA, 20 bp, mouse
ggctgcagagatggccaaag

SEQ ID NO: 833749 - DNA, 20 bp, mouse
gcccctgcagcacttgccca

SEQ ID NO: 833750 - DNA, 20 bp, mouse
gcacaggggtctgccccgaa

SEQ ID NO: 833751 - DNA, 20 bp, mouse
gaagcccctaacaggtgtga

SEQ ID NO: 833752 - DNA, 20 bp, mouse
gaaggcgaagagcgccgccc

SEQ ID NO: 833753 - DNA, 20 bp, mouse
gagatggccaaaggggaccc

SEQ ID NO: 833754 - DNA, 20 bp, mouse
ggcgccgcccgggtcccctt

SEQ ID NO: 833755 - DNA, 20 bp, mouse
ggaggggagaagcccctaac

SEQ ID NO: 833756 - DNA, 20 bp, mouse
gcagggctgaccccaggctg

SEQ ID NO: 833757 - DNA, 20 bp, mouse
ggagtcgtctgggttggcgt

SEQ ID NO: 833758 - DNA, 20 bp, mouse
gtgcgagcggagtcctggca

SEQ ID NO: 833759 - DNA, 20 bp, mouse
gtggcgggagtcgtctgggt

SEQ ID NO: 833760 - DNA, 20 bp, mouse
gccaggctggggatgagtgg

SEQ ID NO: 833761 - DNA, 20 bp, mouse
gtgagtggcgggagtcgtct

SEQ ID NO: 833762 - DNA, 20 bp, mouse
gcacacatggatggcaggga

SEQ ID NO: 833763 - DNA, 20 bp, mouse
ggcagcctccgcagctcagg

SEQ ID NO: 833764 - DNA, 20 bp, mouse
ggcgctgaaggagttaaaca

SEQ ID NO: 833765 - DNA, 20 bp, mouse
ggaggctgcgagcggagtcc

SEQ ID NO: 833766 - DNA, 20 bp, mouse
ggccgatggccatctgctat

SEQ ID NO: 833767 - DNA, 20 bp, mouse
gtaggagatgacaccactgt

SEQ ID NO: 833768 - DNA, 20 bp, mouse
gtggggtcagagcagctctc

SEQ ID NO: 833769 - DNA, 20 bp, mouse
gcgtctgctggctttttctc

SEQ ID NO: 833770 - DNA, 20 bp, mouse
gtggtgtcatctcctaggat

SEQ ID NO: 833771 - DNA, 20 bp, mouse
gagctgctctgaccccacag

SEQ ID NO: 833772 - DNA, 20 bp, mouse
gctctctggaaatcagcctc

SEQ ID NO: 833773 - DNA, 20 bp, mouse
gaggctgcagaagcaggatg

SEQ ID NO: 833774 - DNA, 20 bp, mouse
gtggcgtggatgagatgcaa

SEQ ID NO: 833775 - DNA, 20 bp, mouse
gctggtgctgcagcagccga

SEQ ID NO: 833776 - DNA, 20 bp, mouse
gggaactcaggatgctgatt

SEQ ID NO: 833777 - DNA, 20 bp, mouse
ggagtcctgggtatccagag

SEQ ID NO: 833778 - DNA, 20 bp, mouse
gtacgcgcccgcccacccta

SEQ ID NO: 833779 - DNA, 20 bp, mouse
gcccagcggaagtgacgtgg

SEQ ID NO: 833780 - DNA, 20 bp, mouse
ggtggcagggccaggtctcg

SEQ ID NO: 833781 - DNA, 20 bp, mouse
gtcatcgaatcttgcttcca

SEQ ID NO: 833782 - DNA, 20 bp, mouse
gaggacctgctacctccata

SEQ ID NO: 833783 - DNA, 20 bp, mouse
gaccatgctcaaccgggtag

SEQ ID NO: 833784 - DNA, 20 bp, mouse
gtagcggcttgcttttgccc

SEQ ID NO: 833785 - DNA, 20 bp, mouse
ggcaaaagcaagccgctacc

SEQ ID NO: 833786 - DNA, 20 bp, mouse
gttcaagaaggcaactgtat

SEQ ID NO: 833787 - DNA, 20 bp, mouse
gggcatgcaggcctctagaa

SEQ ID NO: 833788 - DNA, 20 bp, mouse
gcctgcgcgtctcttcaaga

SEQ ID NO: 833789 - DNA, 20 bp, mouse
gagaaggcaactgtatgggc

SEQ ID NO: 833790 - DNA, 20 bp, mouse
gtctccacggcaaccgacgg

SEQ ID NO: 833791 - DNA, 20 bp, mouse
ggaaccaatagcaggcatgc

SEQ ID NO: 833792 - DNA, 20 bp, mouse
ggcaggcacagcactaacac

SEQ ID NO: 833793 - DNA, 20 bp, mouse
gagaagggggtggagctagc

SEQ ID NO: 833794 - DNA, 20 bp, mouse
gtgcccgccgtcggttgccg

SEQ ID NO: 833795 - DNA, 20 bp, mouse
gaggcctgcatgcctgctat

SEQ ID NO: 833796 - DNA, 20 bp, mouse
gtacacgcgaggtgcgggtg

SEQ ID NO: 833797 - DNA, 20 bp, mouse
gtggaatgacagcttgtgat

SEQ ID NO: 833798 - DNA, 20 bp, mouse
gaaaaacaaaaaaccttcgt

SEQ ID NO: 833799 - DNA, 20 bp, mouse
gtacggtctaacagggcgtt

SEQ ID NO: 833800 - DNA, 20 bp, mouse
ggtcacagctgtgagctttt

SEQ ID NO: 833801 - DNA, 20 bp, mouse
gagtacacaaggaagtcacg

SEQ ID NO: 833802 - DNA, 20 bp, mouse
gctgttagaccgtatatctt

SEQ ID NO: 833803 - DNA, 20 bp, mouse
gaacagggcgttaggcatgg

SEQ ID NO: 833804 - DNA, 20 bp, mouse
gggtcgtcttaagccaacga

SEQ ID NO: 833805 - DNA, 20 bp, mouse
gtacctgtgccgactaacaa

SEQ ID NO: 833806 - DNA, 20 bp, mouse
gcatccccagaagggtctct

SEQ ID NO: 833807 - DNA, 20 bp, mouse
gggtccatgcatccccagaa

SEQ ID NO: 833808 - DNA, 20 bp, mouse
gagcctctctacaagaggga

SEQ ID NO: 833809 - DNA, 20 bp, mouse
gcggctgggctcagggactt

SEQ ID NO: 833810 - DNA, 20 bp, mouse
gcacacctagagacccttct

SEQ ID NO: 833811 - DNA, 20 bp, mouse
ggggagcctgtcacccgggg

SEQ ID NO: 833812 - DNA, 20 bp, mouse
gggggagcctctctacaaga

SEQ ID NO: 833813 - DNA, 20 bp, mouse
gtacctgagagtcttctcgt

SEQ ID NO: 833814 - DNA, 20 bp, mouse
gagaaagggcgcaggtaagg

SEQ ID NO: 833815 - DNA, 20 bp, mouse
gagacccttctggggatgca

SEQ ID NO: 833816 - DNA, 20 bp, mouse
gcagcaggatgggtttctgt

SEQ ID NO: 833817 - DNA, 20 bp, mouse
gggggggcctcagtaggcat

SEQ ID NO: 833818 - DNA, 20 bp, mouse
gcctcagtaggcatgggacg

SEQ ID NO: 833819 - DNA, 20 bp, mouse
gcatggccctgcagcaggat

SEQ ID NO: 833820 - DNA, 20 bp, mouse
ggcctactgaggccccccga

SEQ ID NO: 833821 - DNA, 20 bp, mouse
ggaaccggggtgtcagtgcc

SEQ ID NO: 833822 - DNA, 20 bp, mouse
gtgggaccggaaaaagacta

SEQ ID NO: 833823 - DNA, 20 bp, mouse
gtttctgtggggacagaacc

SEQ ID NO: 833824 - DNA, 20 bp, mouse
gaggagagaggcaatgtgag

SEQ ID NO: 833825 - DNA, 20 bp, mouse
gcctgctgcagggccatgag

SEQ ID NO: 833826 - DNA, 20 bp, mouse
ggggggagagacaacgtcat

SEQ ID NO: 833827 - DNA, 20 bp, mouse
gtttaggcggtgggagggga

SEQ ID NO: 833828 - DNA, 20 bp, mouse
ggggaagaggagctagggac

SEQ ID NO: 833829 - DNA, 20 bp, mouse
ggggaggggtgttgcagagc

SEQ ID NO: 833830 - DNA, 20 bp, mouse
gtgtcggctggggacagtcg

SEQ ID NO: 833831 - DNA, 20 bp, mouse
ggaaggtttaggcggtggga

SEQ ID NO: 833832 - DNA, 20 bp, mouse
ggctggggacagtcggggtt

SEQ ID NO: 833833 - DNA, 20 bp, mouse
gactggctgcacagagtggc

SEQ ID NO: 833834 - DNA, 20 bp, mouse
ggctgcacagagtggcaggg

SEQ ID NO: 833835 - DNA, 20 bp, mouse
gaaatgaagcaggctagtga

SEQ ID NO: 833836 - DNA, 20 bp, mouse
gagttcatctgacttctagt

SEQ ID NO: 833837 - DNA, 20 bp, mouse
gggaacactggttaaaaagg

SEQ ID NO: 833838 - DNA, 20 bp, mouse
gcatggaacactggttaaaa

SEQ ID NO: 833839 - DNA, 20 bp, mouse
gactctcaagcatggaacac

SEQ ID NO: 833840 - DNA, 20 bp, mouse
gctagtggttctatatcata

SEQ ID NO: 833841 - DNA, 20 bp, mouse
gtaagtaaactcatgcagag

SEQ ID NO: 833842 - DNA, 20 bp, mouse
gcagatcattgaaccatatg

SEQ ID NO: 833843 - DNA, 20 bp, mouse
gaacgggatgctgaatgtac

SEQ ID NO: 833844 - DNA, 20 bp, mouse
gcagcatataaacacacact

SEQ ID NO: 833845 - DNA, 20 bp, mouse
ggtactcaaatcgctaacca

SEQ ID NO: 833846 - DNA, 20 bp, mouse
gcgcaggcgcagagcgtcat

SEQ ID NO: 833847 - DNA, 20 bp, mouse
ggggacgccggccgacgctg

SEQ ID NO: 833848 - DNA, 20 bp, mouse
gcgtcccacgggaggtattg

SEQ ID NO: 833849 - DNA, 20 bp, mouse
ggggacgggtggggacgctc

SEQ ID NO: 833850 - DNA, 20 bp, mouse
gccgcgggaaagcatcatga

SEQ ID NO: 833851 - DNA, 20 bp, mouse
gtagccccaatacctcccgt

SEQ ID NO: 833852 - DNA, 20 bp, mouse
gggaccggggctgtacatca

SEQ ID NO: 833853 - DNA, 20 bp, mouse
gcggctctcggtcagagagg

SEQ ID NO: 833854 - DNA, 20 bp, mouse
ggggcggctctcggtcagag

SEQ ID NO: 833855 - DNA, 20 bp, mouse
gcaaaccacgatgacctccc

SEQ ID NO: 833856 - DNA, 20 bp, mouse
gagtctcttgtgtagctcaa

SEQ ID NO: 833857 - DNA, 20 bp, mouse
gaggtccaggctgtgagctc

SEQ ID NO: 833858 - DNA, 20 bp, mouse
ggcttcccggggcggagtta

SEQ ID NO: 833859 - DNA, 20 bp, mouse
gcattcgggccaccaggtcc

SEQ ID NO: 833860 - DNA, 20 bp, mouse
gttgtgtagctcaaaggtct

SEQ ID NO: 833861 - DNA, 20 bp, mouse
gacaggtagccctcgggaga

SEQ ID NO: 833862 - DNA, 20 bp, mouse
ggtcatctggcactgcttaa

SEQ ID NO: 833863 - DNA, 20 bp, mouse
ggtcacctgagctcacagcc

SEQ ID NO: 833864 - DNA, 20 bp, mouse
ggcaccccgggacgctgtcg

SEQ ID NO: 833865 - DNA, 20 bp, mouse
gctacacaagagactcattc

SEQ ID NO: 833866 - DNA, 20 bp, mouse
gtggaagcagccatcaagga

SEQ ID NO: 833867 - DNA, 20 bp, mouse
gtggagggaccattaagtaa

SEQ ID NO: 833868 - DNA, 20 bp, mouse
ggcagccatcaaggagggac

SEQ ID NO: 833869 - DNA, 20 bp, mouse
ggggatggtggggcaggcga

SEQ ID NO: 833870 - DNA, 20 bp, mouse
gtatgacccggactggggtg

SEQ ID NO: 833871 - DNA, 20 bp, mouse
gagcttagggcattaagaga

SEQ ID NO: 833872 - DNA, 20 bp, mouse
gtatgcagtagctcctctct

SEQ ID NO: 833873 - DNA, 20 bp, mouse
gctaccattcttcttcttgt

SEQ ID NO: 833874 - DNA, 20 bp, mouse
ggctctcctgctagcctgga

SEQ ID NO: 833875 - DNA, 20 bp, mouse
gagcaaccaactccagccat

SEQ ID NO: 833876 - DNA, 20 bp, mouse
gcgggctgcgtcacagggac

SEQ ID NO: 833877 - DNA, 20 bp, mouse
ggccccgcgccagcatccag

SEQ ID NO: 833878 - DNA, 20 bp, mouse
gcggcgaagtccctccccgg

SEQ ID NO: 833879 - DNA, 20 bp, mouse
ggggtctcgggctgcgtcac

SEQ ID NO: 833880 - DNA, 20 bp, mouse
gggcagggagaccggagcca

SEQ ID NO: 833881 - DNA, 20 bp, mouse
ggggcgcagggagcaccgga

SEQ ID NO: 833882 - DNA, 20 bp, mouse
gacaggcagccgagatgtgg

SEQ ID NO: 833883 - DNA, 20 bp, mouse
gcgcagggagcaccggaggg

SEQ ID NO: 833884 - DNA, 20 bp, mouse
gggccgccgcgcagaccgca

SEQ ID NO: 833885 - DNA, 20 bp, mouse
gcacgtcagcccccacatct

SEQ ID NO: 833886 - DNA, 20 bp, mouse
ggcaggacccgagtcctctc

SEQ ID NO: 833887 - DNA, 20 bp, mouse
gcgggcgcccgcctccttaa

SEQ ID NO: 833888 - DNA, 20 bp, mouse
gcggcggagaccgaggtggc

SEQ ID NO: 833889 - DNA, 20 bp, mouse
gtgctggaggggcgtcttct

SEQ ID NO: 833890 - DNA, 20 bp, mouse
ggcagagcgtcgtgtcaggg

SEQ ID NO: 833891 - DNA, 20 bp, mouse
gagggcggcggagaccgagg

SEQ ID NO: 833892 - DNA, 20 bp, mouse
gtgagcagagcgtcgtgtca

SEQ ID NO: 833893 - DNA, 20 bp, mouse
gctacctctggcagccagag

SEQ ID NO: 833894 - DNA, 20 bp, mouse
gaaaggggccacgcgcttga

SEQ ID NO: 833895 - DNA, 20 bp, mouse
gagccatagctattactgaa

SEQ ID NO: 833896 - DNA, 20 bp, mouse
gtgtcccagcccagagccga

SEQ ID NO: 833897 - DNA, 20 bp, mouse
gcccacaagacggccctcct

SEQ ID NO: 833898 - DNA, 20 bp, mouse
gtcccaggagggccgtcttg

SEQ ID NO: 833899 - DNA, 20 bp, mouse
ggactctaggaggcagtgag

SEQ ID NO: 833900 - DNA, 20 bp, mouse
gagtgttaagcggggaaagt

SEQ ID NO: 833901 - DNA, 20 bp, mouse
gagagagaagaaaggttccg

SEQ ID NO: 833902 - DNA, 20 bp, mouse
gactgcaagagtgttaagcg

SEQ ID NO: 833903 - DNA, 20 bp, mouse
gagtgcaagtgtatctggag

SEQ ID NO: 833904 - DNA, 20 bp, mouse
gggcgagtgatcctcccagg

SEQ ID NO: 833905 - DNA, 20 bp, mouse
ggaaggcgagtgatcctccc

SEQ ID NO: 833906 - DNA, 20 bp, mouse
gctcaggcagccaatcccac

SEQ ID NO: 833907 - DNA, 20 bp, mouse
gcggggacccgcgcctcggt

SEQ ID NO: 833908 - DNA, 20 bp, mouse
ggcacgtagtggctaaagca

SEQ ID NO: 833909 - DNA, 20 bp, mouse
ggcagccgccaattgccaag

SEQ ID NO: 833910 - DNA, 20 bp, mouse
gaggcggcgcctctgcccgt

SEQ ID NO: 833911 - DNA, 20 bp, mouse
ggcgcctctgcccgtgggat

SEQ ID NO: 833912 - DNA, 20 bp, mouse
gccagatcgcgtcacgactc

SEQ ID NO: 833913 - DNA, 20 bp, mouse
gggtgcgggtcgtcccaccg

SEQ ID NO: 833914 - DNA, 20 bp, mouse
ggcagcggggacccgcgcct

SEQ ID NO: 833915 - DNA, 20 bp, mouse
gcagccaatcccacgggcag

SEQ ID NO: 833916 - DNA, 20 bp, mouse
ggccccgcgcacggtcgggc

SEQ ID NO: 833917 - DNA, 20 bp, mouse
ggggcccgggactctggccg

SEQ ID NO: 833918 - DNA, 20 bp, mouse
ggaccgcggcggccctgctg

SEQ ID NO: 833919 - DNA, 20 bp, mouse
gtggccggggagagccccgc

SEQ ID NO: 833920 - DNA, 20 bp, mouse
ggagcatgcgccagaaccta

SEQ ID NO: 833921 - DNA, 20 bp, mouse
gctgaggcgcccagcccgcg

SEQ ID NO: 833922 - DNA, 20 bp, mouse
gcctccgcccttgggcccaa

SEQ ID NO: 833923 - DNA, 20 bp, mouse
gggaccattgggcccaaggg

SEQ ID NO: 833924 - DNA, 20 bp, mouse
ggcgcctctgcctggaccga

SEQ ID NO: 833925 - DNA, 20 bp, mouse
gaggaacgcgaggcggagga

SEQ ID NO: 833926 - DNA, 20 bp, mouse
gccacatcgcgtcccctcga

SEQ ID NO: 833927 - DNA, 20 bp, mouse
gggacgcgatgtgggagcga

SEQ ID NO: 833928 - DNA, 20 bp, mouse
gcggagaagcgcgccctcga

SEQ ID NO: 833929 - DNA, 20 bp, mouse
ggtggcctgggctacagcgg

SEQ ID NO: 833930 - DNA, 20 bp, mouse
gcggcaggaaacctaccccg

SEQ ID NO: 833931 - DNA, 20 bp, mouse
gtgggagcgacggccgatga

SEQ ID NO: 833932 - DNA, 20 bp, mouse
gggagcaccactcccctcat

SEQ ID NO: 833933 - DNA, 20 bp, mouse
ggggcagcgagggaaaagca

SEQ ID NO: 833934 - DNA, 20 bp, mouse
ggaggggagtggtgctcccg

SEQ ID NO: 833935 - DNA, 20 bp, mouse
ggcaaaaggcgccaactgat

SEQ ID NO: 833936 - DNA, 20 bp, mouse
gaacccgaatttaatccccg

SEQ ID NO: 833937 - DNA, 20 bp, mouse
gtcagcggtgtggacacctg

SEQ ID NO: 833938 - DNA, 20 bp, mouse
gagcctcggggattaaattc

SEQ ID NO: 833939 - DNA, 20 bp, mouse
gtgccctggcaactggaatg

SEQ ID NO: 833940 - DNA, 20 bp, mouse
gagaggctgtgacacctttg

SEQ ID NO: 833941 - DNA, 20 bp, mouse
ggggttctcagacttgccgc

SEQ ID NO: 833942 - DNA, 20 bp, mouse
gccaaaagtgccctggcaac

SEQ ID NO: 833943 - DNA, 20 bp, mouse
gaggatagggattgtgatgg

SEQ ID NO: 833944 - DNA, 20 bp, mouse
gtggggtaagactttaaggt

SEQ ID NO: 833945 - DNA, 20 bp, mouse
gcctcaccaagactcctcaa

SEQ ID NO: 833946 - DNA, 20 bp, mouse
gcgagcggcgggtggggtcg

SEQ ID NO: 833947 - DNA, 20 bp, mouse
gaagggacagaattgctccg

SEQ ID NO: 833948 - DNA, 20 bp, mouse
gctgcagaagcacttcggga

SEQ ID NO: 833949 - DNA, 20 bp, mouse
gaatgcgagtgataaatttc

SEQ ID NO: 833950 - DNA, 20 bp, mouse
gcaaatgggaaaagcataca

SEQ ID NO: 833951 - DNA, 20 bp, mouse
gccccgcccgcgcgcgacgg

SEQ ID NO: 833952 - DNA, 20 bp, mouse
ggacacaggggtctcgtgga

SEQ ID NO: 833953 - DNA, 20 bp, mouse
ggcgcgacggcggcgcggaa

SEQ ID NO: 833954 - DNA, 20 bp, mouse
gacggaaccgagcaagctca

SEQ ID NO: 833955 - DNA, 20 bp, mouse
gtgaccccgcccgcgcgcga

SEQ ID NO: 833956 - DNA, 20 bp, mouse
ggtagggaggaggcgggaca

SEQ ID NO: 833957 - DNA, 20 bp, mouse
ggcccgcagggacttcgaga

SEQ ID NO: 833958 - DNA, 20 bp, mouse
ggccggccgaatgatggaga

SEQ ID NO: 833959 - DNA, 20 bp, mouse
gagcgtggccggccgaatga

SEQ ID NO: 833960 - DNA, 20 bp, mouse
gctaaccagcctcacggtgg

SEQ ID NO: 833961 - DNA, 20 bp, mouse
gcctgcgggcggacagggag

SEQ ID NO: 833962 - DNA, 20 bp, mouse
gtgtccgcccgcaggcgccc

SEQ ID NO: 833963 - DNA, 20 bp, mouse
gcgccaaggcctccaccgtg

SEQ ID NO: 833964 - DNA, 20 bp, mouse
gaaggcctccaccgtgaggc

SEQ ID NO: 833965 - DNA, 20 bp, mouse
ggaggaggcgggacagggcg

SEQ ID NO: 833966 - DNA, 20 bp, mouse
ggacccaagcgatgtatcta

SEQ ID NO: 833967 - DNA, 20 bp, mouse
ggaccgcagcaaacgcctca

SEQ ID NO: 833968 - DNA, 20 bp, mouse
gtctctcctaaaccccgcaa

SEQ ID NO: 833969 - DNA, 20 bp, mouse
ggcgcccgcctcccggccga

SEQ ID NO: 833970 - DNA, 20 bp, mouse
gcggggtttaggagagaccc

SEQ ID NO: 833971 - DNA, 20 bp, mouse
ggtgggcggaggaactgctc

SEQ ID NO: 833972 - DNA, 20 bp, mouse
gagaggacgtctgacctttg

SEQ ID NO: 833973 - DNA, 20 bp, mouse
gacggaagctctgaatgcgg

SEQ ID NO: 833974 - DNA, 20 bp, mouse
gactgctcgggagtcagaca

SEQ ID NO: 833975 - DNA, 20 bp, mouse
gaacagacaaccgcctctgg

SEQ ID NO: 833976 - DNA, 20 bp, mouse
gttactgtaacatcctccag

SEQ ID NO: 833977 - DNA, 20 bp, mouse
gcataacattgtgtcctcgg

SEQ ID NO: 833978 - DNA, 20 bp, mouse
ggtctctcagccctcgctgt

SEQ ID NO: 833979 - DNA, 20 bp, mouse
gctcccaggtattggaagag

SEQ ID NO: 833980 - DNA, 20 bp, mouse
gaaacataacattgtgtcct

SEQ ID NO: 833981 - DNA, 20 bp, mouse
gtagccagtatgttcctggt

SEQ ID NO: 833982 - DNA, 20 bp, mouse
gagggtagagtcactgacgt

SEQ ID NO: 833983 - DNA, 20 bp, mouse
gtatgttcctggttggtggg

SEQ ID NO: 833984 - DNA, 20 bp, mouse
ggaagctattcattaaccac

SEQ ID NO: 833985 - DNA, 20 bp, mouse
ggggaaaattccatgggagc

SEQ ID NO: 833986 - DNA, 20 bp, mouse
gagaaagagggcaataaagg

SEQ ID NO: 833987 - DNA, 20 bp, mouse
ggtaagtgaaccctgaggaa

SEQ ID NO: 833988 - DNA, 20 bp, mouse
gaaagggggactactgaggc

SEQ ID NO: 833989 - DNA, 20 bp, mouse
ggggcagaatgagtaacttg

SEQ ID NO: 833990 - DNA, 20 bp, mouse
gcggccagtggagtgagctg

SEQ ID NO: 833991 - DNA, 20 bp, mouse
ggtaacacagactctcacta

SEQ ID NO: 833992 - DNA, 20 bp, mouse
gggggcaaaggtcactatga

SEQ ID NO: 833993 - DNA, 20 bp, mouse
gcaataaagggggactactg

SEQ ID NO: 833994 - DNA, 20 bp, mouse
ggagcctcagctcactccac

SEQ ID NO: 833995 - DNA, 20 bp, mouse
gggggagcggggatgaaaac

SEQ ID NO: 833996 - DNA, 20 bp, mouse
ggggcccaatggtgagatcc

SEQ ID NO: 833997 - DNA, 20 bp, mouse
gcctgaggttgaggtcttgt

SEQ ID NO: 833998 - DNA, 20 bp, mouse
gtgaggtcttgtgggcccaa

SEQ ID NO: 833999 - DNA, 20 bp, mouse
gtggcctggatctcaccatt

SEQ ID NO: 834000 - DNA, 20 bp, mouse
gaaggaatggcctgaggttg

SEQ ID NO: 834001 - DNA, 20 bp, mouse
ggcagagaaggaatggcctg

SEQ ID NO: 834002 - DNA, 20 bp, mouse
gacaaacatagtccaacatc

SEQ ID NO: 834003 - DNA, 20 bp, mouse
gcatagtccaacatcgggat

SEQ ID NO: 834004 - DNA, 20 bp, mouse
gaataacccgatcccgatgt

SEQ ID NO: 834005 - DNA, 20 bp, mouse
gaaacccaaagcctcgacct

SEQ ID NO: 834006 - DNA, 20 bp, mouse
ggggcccaatggtgagatcc

SEQ ID NO: 834007 - DNA, 20 bp, mouse
gcctgaggttgaggtcttgt

SEQ ID NO: 834008 - DNA, 20 bp, mouse
gtgaggtcttgtgggcccaa

SEQ ID NO: 834009 - DNA, 20 bp, mouse
gtggcctggatctcaccatt

SEQ ID NO: 834010 - DNA, 20 bp, mouse
gaaggaatggcctgaggttg

SEQ ID NO: 834011 - DNA, 20 bp, mouse
ggcagagaaggaatggcctg

SEQ ID NO: 834012 - DNA, 20 bp, mouse
gacaaacatagtccaacatc

SEQ ID NO: 834013 - DNA, 20 bp, mouse
gcatagtccaacatcgggat

SEQ ID NO: 834014 - DNA, 20 bp, mouse
gaataacccgatcccgatgt

SEQ ID NO: 834015 - DNA, 20 bp, mouse
gaaacccaaagcctcgacct

SEQ ID NO: 834016 - DNA, 20 bp, mouse
gacaaacatagtccaacatc

SEQ ID NO: 834017 - DNA, 20 bp, mouse
gcatagtccaacatcgggat

SEQ ID NO: 834018 - DNA, 20 bp, mouse
gaataacccgatcccgatgt

SEQ ID NO: 834019 - DNA, 20 bp, mouse
gtacaaaaagagcagtagac

SEQ ID NO: 834020 - DNA, 20 bp, mouse
ggctccacccaaatgaggcg

SEQ ID NO: 834021 - DNA, 20 bp, mouse
gaaacccaaagcctcgacct

SEQ ID NO: 834022 - DNA, 20 bp, mouse
gcaaatgaggagagcaaatg

SEQ ID NO: 834023 - DNA, 20 bp, mouse
gagggatagcctgactctgt

SEQ ID NO: 834024 - DNA, 20 bp, mouse
gagggatggcctacagagtc

SEQ ID NO: 834025 - DNA, 20 bp, mouse
ggatagagtgaaaaacaagt

SEQ ID NO: 834026 - DNA, 20 bp, mouse
gactaggatggggaggccga

SEQ ID NO: 834027 - DNA, 20 bp, mouse
gctgctgcctcccggagcag

SEQ ID NO: 834028 - DNA, 20 bp, mouse
ggaggtggataactaggatg

SEQ ID NO: 834029 - DNA, 20 bp, mouse
gtctccctgtctggcaggct

SEQ ID NO: 834030 - DNA, 20 bp, mouse
gggctgggaggtggataact

SEQ ID NO: 834031 - DNA, 20 bp, mouse
ggcgaaacggtctccctgtc

SEQ ID NO: 834032 - DNA, 20 bp, mouse
ggcaagcgcacgctgctgca

SEQ ID NO: 834033 - DNA, 20 bp, mouse
gaagctgcgcagagagaaaa

SEQ ID NO: 834034 - DNA, 20 bp, mouse
gaacggtctccctgtctggc

SEQ ID NO: 834035 - DNA, 20 bp, mouse
gacctcccagcctgccagac

SEQ ID NO: 834036 - DNA, 20 bp, mouse
gaccaaggactgggtggctc

SEQ ID NO: 834037 - DNA, 20 bp, mouse
gccttccagtctctagtccc

SEQ ID NO: 834038 - DNA, 20 bp, mouse
ggagcccaacgctcggtcag

SEQ ID NO: 834039 - DNA, 20 bp, mouse
ggccacctctgaccgagcgt

SEQ ID NO: 834040 - DNA, 20 bp, mouse
gaagaaacactgtagaccgc

SEQ ID NO: 834041 - DNA, 20 bp, mouse
gtcagctgggggtctgaagt

SEQ ID NO: 834042 - DNA, 20 bp, mouse
ggactgggtggctcaggtgg

SEQ ID NO: 834043 - DNA, 20 bp, mouse
gctggcaggcaccaggacct

SEQ ID NO: 834044 - DNA, 20 bp, mouse
gccgcagaccaaggactggg

SEQ ID NO: 834045 - DNA, 20 bp, mouse
ggccccgcagaccaaggact

SEQ ID NO: 834046 - DNA, 20 bp, mouse
gggagaaactagaaccaatt

SEQ ID NO: 834047 - DNA, 20 bp, mouse
gaatggagaagatgtctggc

SEQ ID NO: 834048 - DNA, 20 bp, mouse
gggcgtctgtaagggaaccg

SEQ ID NO: 834049 - DNA, 20 bp, mouse
gtagctggaggtgtggggtt

SEQ ID NO: 834050 - DNA, 20 bp, mouse
gcagtgggaggcggggttga

SEQ ID NO: 834051 - DNA, 20 bp, mouse
gaggaggagcctgtagaaaa

SEQ ID NO: 834052 - DNA, 20 bp, mouse
gggaggagcggagcagtggg

SEQ ID NO: 834053 - DNA, 20 bp, mouse
gtgggaggcggggttgaggg

SEQ ID NO: 834054 - DNA, 20 bp, mouse
gaaaaggggtggaactttgt

SEQ ID NO: 834055 - DNA, 20 bp, mouse
gggagaagatgtctggcggg

SEQ ID NO: 834056 - DNA, 20 bp, mouse
gggagtcggactgtgggaaa

SEQ ID NO: 834057 - DNA, 20 bp, mouse
ggctgtgagtagcatggagt

SEQ ID NO: 834058 - DNA, 20 bp, mouse
gaaagggtggtgtgaagttt

SEQ ID NO: 834059 - DNA, 20 bp, mouse
ggtagcatggagtcggactg

SEQ ID NO: 834060 - DNA, 20 bp, mouse
gcaggcgcgaacagcctcct

SEQ ID NO: 834061 - DNA, 20 bp, mouse
ggaacagcaccgggcagccc

SEQ ID NO: 834062 - DNA, 20 bp, mouse
gcccacaatgccacgcgcaa

SEQ ID NO: 834063 - DNA, 20 bp, mouse
gatagtgggcgttctttctg

SEQ ID NO: 834064 - DNA, 20 bp, mouse
gaacgggaactaggactatg

SEQ ID NO: 834065 - DNA, 20 bp, mouse
gctgcccggtgctgttcccg

SEQ ID NO: 834066 - DNA, 20 bp, mouse
ggggtcgcctcagcgctaaa

SEQ ID NO: 834067 - DNA, 20 bp, mouse
ggggcaccacgagtagtggg

SEQ ID NO: 834068 - DNA, 20 bp, mouse
gggcgggcaccacgagtagt

SEQ ID NO: 834069 - DNA, 20 bp, mouse
ggggcacgctgggatcgccg

SEQ ID NO: 834070 - DNA, 20 bp, mouse
gcaggccgtgccacagtatg

SEQ ID NO: 834071 - DNA, 20 bp, mouse
ggagaccggacaaagcttga

SEQ ID NO: 834072 - DNA, 20 bp, mouse
ggctaaagggcagagtacca

SEQ ID NO: 834073 - DNA, 20 bp, mouse
gaggctccgcccactactcg

SEQ ID NO: 834074 - DNA, 20 bp, mouse
gccgaggaggccgggcttca

SEQ ID NO: 834075 - DNA, 20 bp, mouse
gccagagcgccgcccgtgcg

SEQ ID NO: 834076 - DNA, 20 bp, mouse
gccagcatccgcaggaggat

SEQ ID NO: 834077 - DNA, 20 bp, mouse
ggggccccagcatccgcagg

SEQ ID NO: 834078 - DNA, 20 bp, mouse
gaactgggactgcaccgccc

SEQ ID NO: 834079 - DNA, 20 bp, mouse
ggctgggccccagcatccgc

SEQ ID NO: 834080 - DNA, 20 bp, mouse
gcaccgcccaggctctctcg

SEQ ID NO: 834081 - DNA, 20 bp, mouse
gaataaccccgagagagcct

SEQ ID NO: 834082 - DNA, 20 bp, mouse
gtccctggggtcctgggggt

SEQ ID NO: 834083 - DNA, 20 bp, mouse
gaatgtgggaatgatctaga

SEQ ID NO: 834084 - DNA, 20 bp, mouse
gggcattcttatgaactccc

SEQ ID NO: 834085 - DNA, 20 bp, mouse
ggagggcaggaatgaaggct

SEQ ID NO: 834086 - DNA, 20 bp, mouse
gacggcttaggagtcttctg

SEQ ID NO: 834087 - DNA, 20 bp, mouse
gttcgcccgccaggtcgggg

SEQ ID NO: 834088 - DNA, 20 bp, mouse
gggaccaagtcagtgcggaa

SEQ ID NO: 834089 - DNA, 20 bp, mouse
gttgaagtaacgaatcacaa

SEQ ID NO: 834090 - DNA, 20 bp, mouse
ggctctgccccctgtggcgt

SEQ ID NO: 834091 - DNA, 20 bp, mouse
gtcccaacgacatcaatcat

SEQ ID NO: 834092 - DNA, 20 bp, mouse
gtgtgcgcgcctctcggcca

SEQ ID NO: 834093 - DNA, 20 bp, mouse
ggcgctcggccctgctagac

SEQ ID NO: 834094 - DNA, 20 bp, mouse
gataccttcgcccgccaggt

SEQ ID NO: 834095 - DNA, 20 bp, mouse
gtcctcctccccgacctggc

SEQ ID NO: 834096 - DNA, 20 bp, mouse
gggagccgggcggaacaggg

SEQ ID NO: 834097 - DNA, 20 bp, mouse
ggcaggagccgggcggaaca

SEQ ID NO: 834098 - DNA, 20 bp, mouse
gagtcaaggctgcctcatcc

SEQ ID NO: 834099 - DNA, 20 bp, mouse
gctaacacaaactaaggtcc

SEQ ID NO: 834100 - DNA, 20 bp, mouse
gtcccgactaacacaaacta

SEQ ID NO: 834101 - DNA, 20 bp, mouse
gtactggtctatcttgtact

SEQ ID NO: 834102 - DNA, 20 bp, mouse
gtggattacacaagcctctg

SEQ ID NO: 834103 - DNA, 20 bp, mouse
gattacacaagcctctgagg

SEQ ID NO: 834104 - DNA, 20 bp, mouse
gagctccgccctgttccgcc

SEQ ID NO: 834105 - DNA, 20 bp, mouse
gtttctaacacaccgggatg

SEQ ID NO: 834106 - DNA, 20 bp, mouse
gaggggatggttcgcttcta

SEQ ID NO: 834107 - DNA, 20 bp, mouse
gctcaggaaacattcttatg

SEQ ID NO: 834108 - DNA, 20 bp, mouse
ggtaaataactgacagggga

SEQ ID NO: 834109 - DNA, 20 bp, mouse
gtcttatgaggtagagtttg

SEQ ID NO: 834110 - DNA, 20 bp, mouse
ggacgtattaacccaactga

SEQ ID NO: 834111 - DNA, 20 bp, mouse
ggtgacccggattagggtat

SEQ ID NO: 834112 - DNA, 20 bp, mouse
gacaactacaggaggcaggt

SEQ ID NO: 834113 - DNA, 20 bp, mouse
gttctccgataccctaatcc

SEQ ID NO: 834114 - DNA, 20 bp, mouse
gcagcgagccaccatctaaa

SEQ ID NO: 834115 - DNA, 20 bp, mouse
gcttctgattgtgtcagctc

SEQ ID NO: 834116 - DNA, 20 bp, mouse
ggctgccagcaggggagcgc

SEQ ID NO: 834117 - DNA, 20 bp, mouse
gcagcccggcgtcccggcgg

SEQ ID NO: 834118 - DNA, 20 bp, mouse
gacgccgggctgcgcctagc

SEQ ID NO: 834119 - DNA, 20 bp, mouse
gcgagagcgccccgccacaa

SEQ ID NO: 834120 - DNA, 20 bp, mouse
ggcggtgcggggcactgggg

SEQ ID NO: 834121 - DNA, 20 bp, mouse
gccagcaggggagcgcggga

SEQ ID NO: 834122 - DNA, 20 bp, mouse
gcggagcccggggtagcgga

SEQ ID NO: 834123 - DNA, 20 bp, mouse
gggcgccccggctgccagca

SEQ ID NO: 834124 - DNA, 20 bp, mouse
gggccccgctcaggccgttg

SEQ ID NO: 834125 - DNA, 20 bp, mouse
gggaggggcccgacaccatg

SEQ ID NO: 834126 - DNA, 20 bp, mouse
gagtcacaagctctgttctt

SEQ ID NO: 834127 - DNA, 20 bp, mouse
gctagaacataaggagacca

SEQ ID NO: 834128 - DNA, 20 bp, mouse
gctcgaatggctagaacata

SEQ ID NO: 834129 - DNA, 20 bp, mouse
gtggcgcagtggtacgagtg

SEQ ID NO: 834130 - DNA, 20 bp, mouse
ggtaatctgcggtctaggat

SEQ ID NO: 834131 - DNA, 20 bp, mouse
gagagaggtaagggctgaac

SEQ ID NO: 834132 - DNA, 20 bp, mouse
gtggcctagaacaggagctt

SEQ ID NO: 834133 - DNA, 20 bp, mouse
gtaccctaaaacaccggcgg

SEQ ID NO: 834134 - DNA, 20 bp, mouse
gttcatgatcagagaggtaa

SEQ ID NO: 834135 - DNA, 20 bp, mouse
ggaggtaagggctgaacggg

SEQ ID NO: 834136 - DNA, 20 bp, mouse
gagtctgcacgcatatgctg

SEQ ID NO: 834137 - DNA, 20 bp, mouse
gggaatgatgaactcttctt

SEQ ID NO: 834138 - DNA, 20 bp, mouse
gtgcgtcagaagtgggttcg

SEQ ID NO: 834139 - DNA, 20 bp, mouse
gggctgtcgggaacaggttc

SEQ ID NO: 834140 - DNA, 20 bp, mouse
gcaacaggcaactacagcat

SEQ ID NO: 834141 - DNA, 20 bp, mouse
gatagtgagtgcgtcagaag

SEQ ID NO: 834142 - DNA, 20 bp, mouse
gcttgagcgtgagacgcagg

SEQ ID NO: 834143 - DNA, 20 bp, mouse
gaggttgttgccagtctggc

SEQ ID NO: 834144 - DNA, 20 bp, mouse
gaaaccatggcaacagcaac

SEQ ID NO: 834145 - DNA, 20 bp, mouse
gagaagtgggttcgaggctg

SEQ ID NO: 834146 - DNA, 20 bp, mouse
ggaaatggggagatgattga

SEQ ID NO: 834147 - DNA, 20 bp, mouse
gccaacagaagcgtcctccc

SEQ ID NO: 834148 - DNA, 20 bp, mouse
ggggagatgattgagggacg

SEQ ID NO: 834149 - DNA, 20 bp, mouse
gttaggagacgccccaggga

SEQ ID NO: 834150 - DNA, 20 bp, mouse
gccctgtgacgacaaagtga

SEQ ID NO: 834151 - DNA, 20 bp, mouse
gggagccgtcaggtcggact

SEQ ID NO: 834152 - DNA, 20 bp, mouse
gcgtcacagggcagatgatc

SEQ ID NO: 834153 - DNA, 20 bp, mouse
gtgattgagggacgagggga

SEQ ID NO: 834154 - DNA, 20 bp, mouse
gcgacgtctgcgcactagga

SEQ ID NO: 834155 - DNA, 20 bp, mouse
gaggtcggactcggtgacct

SEQ ID NO: 834156 - DNA, 20 bp, mouse
gcaggggcggagccagtccc

SEQ ID NO: 834157 - DNA, 20 bp, mouse
gcctgcatggcgcccttccc

SEQ ID NO: 834158 - DNA, 20 bp, mouse
ggaagggcgccatgcagggg

SEQ ID NO: 834159 - DNA, 20 bp, mouse
gcgccctgctcacctgggaa

SEQ ID NO: 834160 - DNA, 20 bp, mouse
gtcctccgtgggcaagtgat

SEQ ID NO: 834161 - DNA, 20 bp, mouse
gaggcagcgcgccccgcaat

SEQ ID NO: 834162 - DNA, 20 bp, mouse
gtggcggaactgagcagtcc

SEQ ID NO: 834163 - DNA, 20 bp, mouse
gtcagacagggaggatcgaa

SEQ ID NO: 834164 - DNA, 20 bp, mouse
gcaatcggcctcacctgcgt

SEQ ID NO: 834165 - DNA, 20 bp, mouse
ggatctggggaaagttgctc

SEQ ID NO: 834166 - DNA, 20 bp, mouse
gggtgaggcacaactctgtg

SEQ ID NO: 834167 - DNA, 20 bp, mouse
gaaccgcactcacattatga

SEQ ID NO: 834168 - DNA, 20 bp, mouse
ggcccttcataatgtgagtg

SEQ ID NO: 834169 - DNA, 20 bp, mouse
gttgtgcctcaccaactctc

SEQ ID NO: 834170 - DNA, 20 bp, mouse
gcacaatcatattatgtatt

SEQ ID NO: 834171 - DNA, 20 bp, mouse
gcatctctccaggcaccata

SEQ ID NO: 834172 - DNA, 20 bp, mouse
ggttcaggtctttaaaggaa

SEQ ID NO: 834173 - DNA, 20 bp, mouse
gggggacagcctatctgttc

SEQ ID NO: 834174 - DNA, 20 bp, mouse
gaatctcaccatatggtgcc

SEQ ID NO: 834175 - DNA, 20 bp, mouse
gtccgttagaattctgttac

SEQ ID NO: 834176 - DNA, 20 bp, mouse
gtccgtgccaattggctcgt

SEQ ID NO: 834177 - DNA, 20 bp, mouse
gaggaaaatcgcctgagtgc

SEQ ID NO: 834178 - DNA, 20 bp, mouse
gaattggctcgtagggaagg

SEQ ID NO: 834179 - DNA, 20 bp, mouse
gagtcaccgggcgtggtttc

SEQ ID NO: 834180 - DNA, 20 bp, mouse
ggttcccggggttgcaaaac

SEQ ID NO: 834181 - DNA, 20 bp, mouse
gaagacgaaagttgcctcgg

SEQ ID NO: 834182 - DNA, 20 bp, mouse
gcaccgggcgtggtttccgg

SEQ ID NO: 834183 - DNA, 20 bp, mouse
gtgactcacgtggaaacgaa

SEQ ID NO: 834184 - DNA, 20 bp, mouse
gttcggagaaaggccttaaa

SEQ ID NO: 834185 - DNA, 20 bp, mouse
gtgcctccggaaaccacgcc

SEQ ID NO: 834186 - DNA, 20 bp, mouse
gacggaagggcaggtgtgag

SEQ ID NO: 834187 - DNA, 20 bp, mouse
gcacctccctgcgtaaagga

SEQ ID NO: 834188 - DNA, 20 bp, mouse
gcaactcctaagtgcaaaga

SEQ ID NO: 834189 - DNA, 20 bp, mouse
gagactagtggattgattga

SEQ ID NO: 834190 - DNA, 20 bp, mouse
gtgtagacaccaatgacttc

SEQ ID NO: 834191 - DNA, 20 bp, mouse
gagggggagtggataacgga

SEQ ID NO: 834192 - DNA, 20 bp, mouse
ggcagggaggtgcaagcgta

SEQ ID NO: 834193 - DNA, 20 bp, mouse
gctagtcttcccgaagtcat

SEQ ID NO: 834194 - DNA, 20 bp, mouse
gcttgcacctccctgcgtaa

SEQ ID NO: 834195 - DNA, 20 bp, mouse
gtgaaagggggagtggataa

SEQ ID NO: 834196 - DNA, 20 bp, mouse
ggcgccctgggtcccagaga

SEQ ID NO: 834197 - DNA, 20 bp, mouse
ggtcccagagaaggggtgag

SEQ ID NO: 834198 - DNA, 20 bp, mouse
ggaagggccaagagtcggga

SEQ ID NO: 834199 - DNA, 20 bp, mouse
gtgggcggggcgcaagccgg

SEQ ID NO: 834200 - DNA, 20 bp, mouse
gtcaccgctcaccccttctc

SEQ ID NO: 834201 - DNA, 20 bp, mouse
gcaggggaagatcgcgagcc

SEQ ID NO: 834202 - DNA, 20 bp, mouse
ggcacctaggtgcaaagtgg

SEQ ID NO: 834203 - DNA, 20 bp, mouse
gtcgaggaatctgcatccag

SEQ ID NO: 834204 - DNA, 20 bp, mouse
ggaaggggtgagcggtgacc

SEQ ID NO: 834205 - DNA, 20 bp, mouse
gcggtccaaggtcacacacc

SEQ ID NO: 834206 - DNA, 20 bp, mouse
gcagccgggagcccaaaatg

SEQ ID NO: 834207 - DNA, 20 bp, mouse
gctaactacgcagatgttta

SEQ ID NO: 834208 - DNA, 20 bp, mouse
gtggttagtcccatggaaaa

SEQ ID NO: 834209 - DNA, 20 bp, mouse
gctggggtccacaaagagga

SEQ ID NO: 834210 - DNA, 20 bp, mouse
gcccaaaatgcggggccgta

SEQ ID NO: 834211 - DNA, 20 bp, mouse
gtggcgagggagcattcgtc

SEQ ID NO: 834212 - DNA, 20 bp, mouse
gaccacccctcctctcccga

SEQ ID NO: 834213 - DNA, 20 bp, mouse
gccacccctcgggagaggag

SEQ ID NO: 834214 - DNA, 20 bp, mouse
ggggacgcacggggccgggg

SEQ ID NO: 834215 - DNA, 20 bp, mouse
gcggtgcctggcagtggggc

SEQ ID NO: 834216 - DNA, 20 bp, mouse
gccggagccggaacgagggg

SEQ ID NO: 834217 - DNA, 20 bp, mouse
ggggccggagccggaacgag

SEQ ID NO: 834218 - DNA, 20 bp, mouse
gggggcggggtccggaacgg

SEQ ID NO: 834219 - DNA, 20 bp, mouse
gagggccccgcccctcgttc

SEQ ID NO: 834220 - DNA, 20 bp, mouse
gcgcgtgcgccctggagcct

SEQ ID NO: 834221 - DNA, 20 bp, mouse
gtcagtgccagctgacccaa

SEQ ID NO: 834222 - DNA, 20 bp, mouse
ggccctggttctcctaaaaa

SEQ ID NO: 834223 - DNA, 20 bp, mouse
ggcggcagccggttcccctc

SEQ ID NO: 834224 - DNA, 20 bp, mouse
ggcggggtccggaacggggg

SEQ ID NO: 834225 - DNA, 20 bp, mouse
ggcagccggttcccctccgg

SEQ ID NO: 834226 - DNA, 20 bp, mouse
gcctgcgcagtgggactctc

SEQ ID NO: 834227 - DNA, 20 bp, mouse
gtcccggcgcacctgcgcag

SEQ ID NO: 834228 - DNA, 20 bp, mouse
gaaactccgccgggcacgta

SEQ ID NO: 834229 - DNA, 20 bp, mouse
gccgccgggcacgtatgggc

SEQ ID NO: 834230 - DNA, 20 bp, mouse
gtcccactgcgcaggtgcgc

SEQ ID NO: 834231 - DNA, 20 bp, mouse
gggccggaaagcccgggcgc

SEQ ID NO: 834232 - DNA, 20 bp, mouse
gcgtatgggccggaaagccc

SEQ ID NO: 834233 - DNA, 20 bp, mouse
gagctggctcgccctcctcc

SEQ ID NO: 834234 - DNA, 20 bp, mouse
gcggacgcctgccccttgca

SEQ ID NO: 834235 - DNA, 20 bp, mouse
gactggagccagggaaaatt

SEQ ID NO: 834236 - DNA, 20 bp, mouse
gcagggtgaagaaacacggg

SEQ ID NO: 834237 - DNA, 20 bp, mouse
gcgggagcgcgcttcttaaa

SEQ ID NO: 834238 - DNA, 20 bp, mouse
gtgctcaagagattctggag

SEQ ID NO: 834239 - DNA, 20 bp, mouse
ggcagctgcgggaaaggcgt

SEQ ID NO: 834240 - DNA, 20 bp, mouse
gggagcgtgcggctgatacc

SEQ ID NO: 834241 - DNA, 20 bp, mouse
gtcctcctctaagtcagaac

SEQ ID NO: 834242 - DNA, 20 bp, mouse
gtagaggcaaaaggccgctc

SEQ ID NO: 834243 - DNA, 20 bp, mouse
gtcaccctgttctgacttag

SEQ ID NO: 834244 - DNA, 20 bp, mouse
gagcagccggagggagcgtg

SEQ ID NO: 834245 - DNA, 20 bp, mouse
gagaacagggtgaagaaaca

SEQ ID NO: 834246 - DNA, 20 bp, mouse
ggggcccaggggcaacgtca

SEQ ID NO: 834247 - DNA, 20 bp, mouse
gagcccctcttaggatgctg

SEQ ID NO: 834248 - DNA, 20 bp, mouse
ggggaagaggcaagtcagac

SEQ ID NO: 834249 - DNA, 20 bp, mouse
ggccaccatcagcccctctt

SEQ ID NO: 834250 - DNA, 20 bp, mouse
gcaccctggtgctgtggcat

SEQ ID NO: 834251 - DNA, 20 bp, mouse
ggacctggggaggtccacca

SEQ ID NO: 834252 - DNA, 20 bp, mouse
gttcccccagcatcctaaga

SEQ ID NO: 834253 - DNA, 20 bp, mouse
gtgagccagcgggggcccag

SEQ ID NO: 834254 - DNA, 20 bp, mouse
gggctgatagcaccacagga

SEQ ID NO: 834255 - DNA, 20 bp, mouse
gtcgtgacaaactccaggaa

SEQ ID NO: 834256 - DNA, 20 bp, mouse
ggtgctgggcaagagctcta

SEQ ID NO: 834257 - DNA, 20 bp, mouse
gcctgagtctagcacctctc

SEQ ID NO: 834258 - DNA, 20 bp, mouse
gagtctagcacctctctggt

SEQ ID NO: 834259 - DNA, 20 bp, mouse
gcgctgctgtgaatagacaa

SEQ ID NO: 834260 - DNA, 20 bp, mouse
gaatagaatgtaggcctcct

SEQ ID NO: 834261 - DNA, 20 bp, mouse
gattctattcacagcactgg

SEQ ID NO: 834262 - DNA, 20 bp, mouse
ggctgtgggtggaagtattt

SEQ ID NO: 834263 - DNA, 20 bp, mouse
gtggatgccaaggactttga

SEQ ID NO: 834264 - DNA, 20 bp, mouse
gagcactttcagagagtggc

SEQ ID NO: 834265 - DNA, 20 bp, mouse
gctgtgaatagacaagggaa

SEQ ID NO: 834266 - DNA, 20 bp, mouse
gtgacagagctgggagatct

SEQ ID NO: 834267 - DNA, 20 bp, mouse
gctgcaagctaggttgtggc

SEQ ID NO: 834268 - DNA, 20 bp, mouse
gtctgtcacagggaaggcgt

SEQ ID NO: 834269 - DNA, 20 bp, mouse
gcccagtcggcgcacgggga

SEQ ID NO: 834270 - DNA, 20 bp, mouse
ggtcacagggaaggcgttgg

SEQ ID NO: 834271 - DNA, 20 bp, mouse
gcatgctgcaagctaggttg

SEQ ID NO: 834272 - DNA, 20 bp, mouse
gcgagggcggagctttgcga

SEQ ID NO: 834273 - DNA, 20 bp, mouse
ggcggagcgcgttcttggac

SEQ ID NO: 834274 - DNA, 20 bp, mouse
gaatgtgagactgacaccga

SEQ ID NO: 834275 - DNA, 20 bp, mouse
ggaccgccatgctgcaagct

SEQ ID NO: 834276 - DNA, 20 bp, mouse
gagcgcgcgaggttcgtggg

SEQ ID NO: 834277 - DNA, 20 bp, mouse
gcgccctacaccagcgaggt

SEQ ID NO: 834278 - DNA, 20 bp, mouse
ggaaagctacgcggagaagt

SEQ ID NO: 834279 - DNA, 20 bp, mouse
gggccctcacctgatatctc

SEQ ID NO: 834280 - DNA, 20 bp, mouse
gtatcgcattggcaagtcat

SEQ ID NO: 834281 - DNA, 20 bp, mouse
gttggcaagtcatgggtctg

SEQ ID NO: 834282 - DNA, 20 bp, mouse
gccgtgtgacgaaagctacg

SEQ ID NO: 834283 - DNA, 20 bp, mouse
gcgggagcgcgcgaggttcg

SEQ ID NO: 834284 - DNA, 20 bp, mouse
gagtcgcgcgcagacacttc

SEQ ID NO: 834285 - DNA, 20 bp, mouse
gtcggccctgacttgtctcg

SEQ ID NO: 834286 - DNA, 20 bp, mouse
gaacctgggggatgggaatc

SEQ ID NO: 834287 - DNA, 20 bp, mouse
ggcaggctctccttagtcgc

SEQ ID NO: 834288 - DNA, 20 bp, mouse
gtaaggagagcctgcggctc

SEQ ID NO: 834289 - DNA, 20 bp, mouse
gcctgcggctccggcgaacc

SEQ ID NO: 834290 - DNA, 20 bp, mouse
ggcggctccggcgaacctgg

SEQ ID NO: 834291 - DNA, 20 bp, mouse
gcctacaaatgaaaggaatc

SEQ ID NO: 834292 - DNA, 20 bp, mouse
gtgcacacgctgcagggtat

SEQ ID NO: 834293 - DNA, 20 bp, mouse
gcccgccgtgagcccggcta

SEQ ID NO: 834294 - DNA, 20 bp, mouse
gaaggaagcgtgctaccgag

SEQ ID NO: 834295 - DNA, 20 bp, mouse
ggaggaccgtgcgccactga

SEQ ID NO: 834296 - DNA, 20 bp, mouse
gtctagttggagaggcgcaa

SEQ ID NO: 834297 - DNA, 20 bp, mouse
gcaggcctgagaagcggcga

SEQ ID NO: 834298 - DNA, 20 bp, mouse
ggcgcaccagtgaaatacag

SEQ ID NO: 834299 - DNA, 20 bp, mouse
gcgcacgcgcagacaacttg

SEQ ID NO: 834300 - DNA, 20 bp, mouse
gtggcgaacgtgtcagacgt

SEQ ID NO: 834301 - DNA, 20 bp, mouse
gtgcgcgctgcaagatttct

SEQ ID NO: 834302 - DNA, 20 bp, mouse
gcgcggcgggcaggcctgga

SEQ ID NO: 834303 - DNA, 20 bp, mouse
gacaaaccactgtatttcac

SEQ ID NO: 834304 - DNA, 20 bp, mouse
ggaagcggcgagggaggtca

SEQ ID NO: 834305 - DNA, 20 bp, mouse
gcggctgtgggccctttagt

SEQ ID NO: 834306 - DNA, 20 bp, mouse
gcagcacaaaagtgtggggt

SEQ ID NO: 834307 - DNA, 20 bp, mouse
ggcggccgctgcacaaagga

SEQ ID NO: 834308 - DNA, 20 bp, mouse
gccaaagccagacaatactc

SEQ ID NO: 834309 - DNA, 20 bp, mouse
gcgcggaccagcgctagtgg

SEQ ID NO: 834310 - DNA, 20 bp, mouse
ggtggggtgggggacggatg

SEQ ID NO: 834311 - DNA, 20 bp, mouse
ggaaccgggcgaacccgcaa

SEQ ID NO: 834312 - DNA, 20 bp, mouse
gaccagcgctagtgggggga

SEQ ID NO: 834313 - DNA, 20 bp, mouse
gaattgtgcggcaccgtggt

SEQ ID NO: 834314 - DNA, 20 bp, mouse
gccccgaggagcgttgtccc

SEQ ID NO: 834315 - DNA, 20 bp, mouse
gtggcgcggaccagcgctag

SEQ ID NO: 834316 - DNA, 20 bp, mouse
gtggggtggggtagttggaa

SEQ ID NO: 834317 - DNA, 20 bp, mouse
gaggatgcgagtggcccagt

SEQ ID NO: 834318 - DNA, 20 bp, mouse
gatgtggcactgcgtggcag

SEQ ID NO: 834319 - DNA, 20 bp, mouse
gggccactcgcatcctagaa

SEQ ID NO: 834320 - DNA, 20 bp, mouse
gcctagaaaggaacttagct

SEQ ID NO: 834321 - DNA, 20 bp, mouse
ggcctgccctcacggaccaa

SEQ ID NO: 834322 - DNA, 20 bp, mouse
gcctcacggaccaagggcag

SEQ ID NO: 834323 - DNA, 20 bp, mouse
gcgctgtgcagtcgctgatg

SEQ ID NO: 834324 - DNA, 20 bp, mouse
gcaatctgcctccacccact

SEQ ID NO: 834325 - DNA, 20 bp, mouse
gtgactggggttgcagttgg

SEQ ID NO: 834326 - DNA, 20 bp, mouse
gaggggactctcagaaacag

SEQ ID NO: 834327 - DNA, 20 bp, mouse
gacactcggaagcagggaaa

SEQ ID NO: 834328 - DNA, 20 bp, mouse
gctgctgctagcacgacctc

SEQ ID NO: 834329 - DNA, 20 bp, mouse
ggcagggttagggccatctg

SEQ ID NO: 834330 - DNA, 20 bp, mouse
gctgctagcacgacctcagg

SEQ ID NO: 834331 - DNA, 20 bp, mouse
gtcaccgccaaggaaggctc

SEQ ID NO: 834332 - DNA, 20 bp, mouse
gacaggggacactcggaagc

SEQ ID NO: 834333 - DNA, 20 bp, mouse
gagaggctttcggggaccac

SEQ ID NO: 834334 - DNA, 20 bp, mouse
ggaaagcctctctgaagcag

SEQ ID NO: 834335 - DNA, 20 bp, mouse
gccgccaaggaaggctccgg

SEQ ID NO: 834336 - DNA, 20 bp, mouse
gcccggacggcggaaggctc

SEQ ID NO: 834337 - DNA, 20 bp, mouse
gagggtctgcacccggacgg

SEQ ID NO: 834338 - DNA, 20 bp, mouse
gtgacccggagacagggcga

SEQ ID NO: 834339 - DNA, 20 bp, mouse
gtgctgcgcgcagtgaccaa

SEQ ID NO: 834340 - DNA, 20 bp, mouse
gggtctcgccactaatccct

SEQ ID NO: 834341 - DNA, 20 bp, mouse
gtctgcacccggacggcgga

SEQ ID NO: 834342 - DNA, 20 bp, mouse
gccccggagcaaccgcggtc

SEQ ID NO: 834343 - DNA, 20 bp, mouse
gaccctcagtctctctccta

SEQ ID NO: 834344 - DNA, 20 bp, mouse
gagcgaccccggagcaaccg

SEQ ID NO: 834345 - DNA, 20 bp, mouse
ggctccctcgccctgtctcc

SEQ ID NO: 834346 - DNA, 20 bp, mouse
gaggaggcggggtctgaggt

SEQ ID NO: 834347 - DNA, 20 bp, mouse
gagggaggctggctgtaagg

SEQ ID NO: 834348 - DNA, 20 bp, mouse
gggtctgaggtcggcagccc

SEQ ID NO: 834349 - DNA, 20 bp, mouse
ggcggggccgaaggagcgga

SEQ ID NO: 834350 - DNA, 20 bp, mouse
gagagagactagttgtgagg

SEQ ID NO: 834351 - DNA, 20 bp, mouse
ggctgtgaaatggctgagtg

SEQ ID NO: 834352 - DNA, 20 bp, mouse
gcggagcctgagtgccgctg

SEQ ID NO: 834353 - DNA, 20 bp, mouse
gtccccgccctccgctcctt

SEQ ID NO: 834354 - DNA, 20 bp, mouse
gagaaaagctatgggtgcgg

SEQ ID NO: 834355 - DNA, 20 bp, mouse
ggggctgttttaaggacagg

SEQ ID NO: 834356 - DNA, 20 bp, mouse
gcatgcggatcgagagcgaa

SEQ ID NO: 834357 - DNA, 20 bp, mouse
gagagtggagcctgtcttct

SEQ ID NO: 834358 - DNA, 20 bp, mouse
gagcgaagggcggatccctg

SEQ ID NO: 834359 - DNA, 20 bp, mouse
gcgcatgcgcactgactcgg

SEQ ID NO: 834360 - DNA, 20 bp, mouse
gctgggatgggaccaaggaa

SEQ ID NO: 834361 - DNA, 20 bp, mouse
gaccgcgccgacaagtctgt

SEQ ID NO: 834362 - DNA, 20 bp, mouse
gggagcctgtcttctgggat

SEQ ID NO: 834363 - DNA, 20 bp, mouse
ggtcttctgggatgggacca

SEQ ID NO: 834364 - DNA, 20 bp, mouse
gactgtgagaaatgctagag

SEQ ID NO: 834365 - DNA, 20 bp, mouse
gtcacagtgacaagggagtc

SEQ ID NO: 834366 - DNA, 20 bp, mouse
ggggacctcagaggcggaac

SEQ ID NO: 834367 - DNA, 20 bp, mouse
ggggaccgggacctcagagg

SEQ ID NO: 834368 - DNA, 20 bp, mouse
ggggcataacccctggaggc

SEQ ID NO: 834369 - DNA, 20 bp, mouse
ggcgcaccgcaggaaccaat

SEQ ID NO: 834370 - DNA, 20 bp, mouse
gggcgggaccgggacctcag

SEQ ID NO: 834371 - DNA, 20 bp, mouse
ggtgggcggggcataacccc

SEQ ID NO: 834372 - DNA, 20 bp, mouse
ggctggacccgtgcgctctg

SEQ ID NO: 834373 - DNA, 20 bp, mouse
gctcagaggcggaacggggc

SEQ ID NO: 834374 - DNA, 20 bp, mouse
gggcggggcttgattcctga

SEQ ID NO: 834375 - DNA, 20 bp, mouse
gcggtgctctacctgcgtcc

SEQ ID NO: 834376 - DNA, 20 bp, mouse
gtcccggacctcctactctg

SEQ ID NO: 834377 - DNA, 20 bp, mouse
gggagctgggagtccctgtt

SEQ ID NO: 834378 - DNA, 20 bp, mouse
ggcggcctgcgcgcacaaga

SEQ ID NO: 834379 - DNA, 20 bp, mouse
gctggggaatggctgtctac

SEQ ID NO: 834380 - DNA, 20 bp, mouse
gcaggcggggacccggaccc

SEQ ID NO: 834381 - DNA, 20 bp, mouse
gaccgaaagcgtgagctgag

SEQ ID NO: 834382 - DNA, 20 bp, mouse
gagcctcagagtaggaggtc

SEQ ID NO: 834383 - DNA, 20 bp, mouse
gtggggcacttgagggataa

SEQ ID NO: 834384 - DNA, 20 bp, mouse
ggtggcgtagggcgcagggt

SEQ ID NO: 834385 - DNA, 20 bp, mouse
gggaccctgcactgcgttgc

SEQ ID NO: 834386 - DNA, 20 bp, mouse
ggagggacgcataccaaggt

SEQ ID NO: 834387 - DNA, 20 bp, mouse
gttcagtgggagccctaaga

SEQ ID NO: 834388 - DNA, 20 bp, mouse
gctctctgggcatgggacat

SEQ ID NO: 834389 - DNA, 20 bp, mouse
gtgatccttgatgacacaga

SEQ ID NO: 834390 - DNA, 20 bp, mouse
gggaaggcccagcatattaa

SEQ ID NO: 834391 - DNA, 20 bp, mouse
gcaccctcacacttcacaat

SEQ ID NO: 834392 - DNA, 20 bp, mouse
gcttgtcagctgaaggtcca

SEQ ID NO: 834393 - DNA, 20 bp, mouse
gtctcctgaaacttgtggtc

SEQ ID NO: 834394 - DNA, 20 bp, mouse
gcaaggagggacgcatacca

SEQ ID NO: 834395 - DNA, 20 bp, mouse
gaaggatcaagatctttcag

SEQ ID NO: 834396 - DNA, 20 bp, mouse
ggcagggttgattatcaaca

SEQ ID NO: 834397 - DNA, 20 bp, mouse
gtgattatcaacacggtaag

SEQ ID NO: 834398 - DNA, 20 bp, mouse
gctactttagagtaggtagt

SEQ ID NO: 834399 - DNA, 20 bp, mouse
ggaggtcttgctgttcccta

SEQ ID NO: 834400 - DNA, 20 bp, mouse
gcggtaaggggagagtttta

SEQ ID NO: 834401 - DNA, 20 bp, mouse
ggaaactagttacacactct

SEQ ID NO: 834402 - DNA, 20 bp, mouse
gacggttccatctactgagg

SEQ ID NO: 834403 - DNA, 20 bp, mouse
gagtgtgttaacttggaaaa

SEQ ID NO: 834404 - DNA, 20 bp, mouse
gatctcttagtcctgctgaa

SEQ ID NO: 834405 - DNA, 20 bp, mouse
gggaaagtaagactacccta

SEQ ID NO: 834406 - DNA, 20 bp, mouse
ggggcggggcgcggttgcta

SEQ ID NO: 834407 - DNA, 20 bp, mouse
ggaggcgcgaagcgactccc

SEQ ID NO: 834408 - DNA, 20 bp, mouse
gtggggcccaaagacagtag

SEQ ID NO: 834409 - DNA, 20 bp, mouse
gcccaaagacagtaggggcg

SEQ ID NO: 834410 - DNA, 20 bp, mouse
gctgtgaaggtaagagtcgg

SEQ ID NO: 834411 - DNA, 20 bp, mouse
ggccccgcccctactgtctt

SEQ ID NO: 834412 - DNA, 20 bp, mouse
gactccctggttgctaggca

SEQ ID NO: 834413 - DNA, 20 bp, mouse
gcgaccgcaccctcctgtga

SEQ ID NO: 834414 - DNA, 20 bp, mouse
ggggcgcggttgctagggcc

SEQ ID NO: 834415 - DNA, 20 bp, mouse
gtaaacctgtgggttgagac

SEQ ID NO: 834416 - DNA, 20 bp, mouse
gggcgtgcgaggaggaacga

SEQ ID NO: 834417 - DNA, 20 bp, mouse
ggggcgaccccgggactgtg

SEQ ID NO: 834418 - DNA, 20 bp, mouse
gcgaccccggatggtggtga

SEQ ID NO: 834419 - DNA, 20 bp, mouse
gggactgtgcggctgagtca

SEQ ID NO: 834420 - DNA, 20 bp, mouse
ggcaacgcgcgcaggacgcc

SEQ ID NO: 834421 - DNA, 20 bp, mouse
gcggaccggctgggcgaccc

SEQ ID NO: 834422 - DNA, 20 bp, mouse
gttgccgaggccggtcggac

SEQ ID NO: 834423 - DNA, 20 bp, mouse
gtgggcgactgaggggtgca

SEQ ID NO: 834424 - DNA, 20 bp, mouse
ggagcctcaatgtccatcgg

SEQ ID NO: 834425 - DNA, 20 bp, mouse
gcggcctcggcaacgcgcgc

SEQ ID NO: 834426 - DNA, 20 bp, mouse
gaggaaagaaagagcccggg

SEQ ID NO: 834427 - DNA, 20 bp, mouse
gggagacgggaggactgatt

SEQ ID NO: 834428 - DNA, 20 bp, mouse
gacgccgggaggcatgctgg

SEQ ID NO: 834429 - DNA, 20 bp, mouse
gccagccagtctgagaaaag

SEQ ID NO: 834430 - DNA, 20 bp, mouse
ggtcacaaggcaggaggcgg

SEQ ID NO: 834431 - DNA, 20 bp, mouse
ggggcccaggatgtgtcaca

SEQ ID NO: 834432 - DNA, 20 bp, mouse
gacggcctccgggagggccc

SEQ ID NO: 834433 - DNA, 20 bp, mouse
ggggaggactgattaggaag

SEQ ID NO: 834434 - DNA, 20 bp, mouse
gtgcgggaccgcgaggccgg

SEQ ID NO: 834435 - DNA, 20 bp, mouse
gaaagaaagagcccgggagg

SEQ ID NO: 834436 - DNA, 20 bp, mouse
gtacctccggcccaggtggg

SEQ ID NO: 834437 - DNA, 20 bp, mouse
gtgtgcgagcgattggaagt

SEQ ID NO: 834438 - DNA, 20 bp, mouse
gggacgctcccttacaaacc

SEQ ID NO: 834439 - DNA, 20 bp, mouse
ggtgacacgtctctctccaa

SEQ ID NO: 834440 - DNA, 20 bp, mouse
gcgagcgattggaagtgggg

SEQ ID NO: 834441 - DNA, 20 bp, mouse
ggggagacttgggcccaatg

SEQ ID NO: 834442 - DNA, 20 bp, mouse
ggccgccccgctcacgtgac

SEQ ID NO: 834443 - DNA, 20 bp, mouse
gcgtctctctccaatggaga

SEQ ID NO: 834444 - DNA, 20 bp, mouse
ggaggagcgactcacgcgac

SEQ ID NO: 834445 - DNA, 20 bp, mouse
gcacgtgagcggggcggcac

SEQ ID NO: 834446 - DNA, 20 bp, mouse
gaagccgcgagcttaggcgg

SEQ ID NO: 834447 - DNA, 20 bp, mouse
gtcgaagccgcgagcttagg

SEQ ID NO: 834448 - DNA, 20 bp, mouse
ggcacactgcacccgggcag

SEQ ID NO: 834449 - DNA, 20 bp, mouse
gagcgccagcccagtccgag

SEQ ID NO: 834450 - DNA, 20 bp, mouse
gcttaggcggtgggctgcga

SEQ ID NO: 834451 - DNA, 20 bp, mouse
gggggcgctgaccaacgcgg

SEQ ID NO: 834452 - DNA, 20 bp, mouse
ggcagaggtgtgagctctca

SEQ ID NO: 834453 - DNA, 20 bp, mouse
ggcgcgtggggcccacctcc

SEQ ID NO: 834454 - DNA, 20 bp, mouse
gagcccaccgcctaagctcg

SEQ ID NO: 834455 - DNA, 20 bp, mouse
gggccgcggccgctcggact

SEQ ID NO: 834456 - DNA, 20 bp, mouse
gggcccgcatagccaatcga

SEQ ID NO: 834457 - DNA, 20 bp, mouse
gcctcagcgggcaccgggat

SEQ ID NO: 834458 - DNA, 20 bp, mouse
gctggcgtgtgagaaccgaa

SEQ ID NO: 834459 - DNA, 20 bp, mouse
gagggtccgtgttgcctcag

SEQ ID NO: 834460 - DNA, 20 bp, mouse
ggcgcggcggcgccttcgat

SEQ ID NO: 834461 - DNA, 20 bp, mouse
gggtgcccgctgaggcaaca

SEQ ID NO: 834462 - DNA, 20 bp, mouse
gcggctggctggtgcggggc

SEQ ID NO: 834463 - DNA, 20 bp, mouse
gcgggcggctggctggtgcg

SEQ ID NO: 834464 - DNA, 20 bp, mouse
ggccgtggggaggcccacgt

SEQ ID NO: 834465 - DNA, 20 bp, mouse
gcgccgcgcacggccaatcc

SEQ ID NO: 834466 - DNA, 20 bp, mouse
ggggacggaaaacctctcgt

SEQ ID NO: 834467 - DNA, 20 bp, mouse
gtggggccagtagttctcgg

SEQ ID NO: 834468 - DNA, 20 bp, mouse
gctgcctcctggccggtctc

SEQ ID NO: 834469 - DNA, 20 bp, mouse
gccgccccggtccgcccaat

SEQ ID NO: 834470 - DNA, 20 bp, mouse
gggccaggaggcagccgatt

SEQ ID NO: 834471 - DNA, 20 bp, mouse
gcggcctggcacggagaaag

SEQ ID NO: 834472 - DNA, 20 bp, mouse
gtcctggccggtctctggga

SEQ ID NO: 834473 - DNA, 20 bp, mouse
ggcgaggcgtgcggaagctg

SEQ ID NO: 834474 - DNA, 20 bp, mouse
gtctgagcccaaggctgaga

SEQ ID NO: 834475 - DNA, 20 bp, mouse
gccggggcccagttcctcgc

SEQ ID NO: 834476 - DNA, 20 bp, mouse
gggcaggtgaatctctactc

SEQ ID NO: 834477 - DNA, 20 bp, mouse
gcgtgccgggaatgacaaag

SEQ ID NO: 834478 - DNA, 20 bp, mouse
gggatgaaggccaagagcaa

SEQ ID NO: 834479 - DNA, 20 bp, mouse
ggggaagaggagtatggaca

SEQ ID NO: 834480 - DNA, 20 bp, mouse
gcggacttggatctgcgtgc

SEQ ID NO: 834481 - DNA, 20 bp, mouse
gtcactgagcgaggcagcct

SEQ ID NO: 834482 - DNA, 20 bp, mouse
gacggtgacaggcctatctc

SEQ ID NO: 834483 - DNA, 20 bp, mouse
ggggtgtgctgcggcgagcg

SEQ ID NO: 834484 - DNA, 20 bp, mouse
gcctggctagatacggtgac

SEQ ID NO: 834485 - DNA, 20 bp, mouse
gggccaagagcaacggggca

SEQ ID NO: 834486 - DNA, 20 bp, mouse
gagcccgcaggttacgggac

SEQ ID NO: 834487 - DNA, 20 bp, mouse
ggagacgcgcagagtcgcga

SEQ ID NO: 834488 - DNA, 20 bp, mouse
ggggaccgggcgagaggggt

SEQ ID NO: 834489 - DNA, 20 bp, mouse
gtgggcggaaccttgaggtg

SEQ ID NO: 834490 - DNA, 20 bp, mouse
gtctcctagccgcttcccag

SEQ ID NO: 834491 - DNA, 20 bp, mouse
gacggagggcagtcagttac

SEQ ID NO: 834492 - DNA, 20 bp, mouse
gggactaaggggcgggccca

SEQ ID NO: 834493 - DNA, 20 bp, mouse
gcgcccggtcccgtaacctg

SEQ ID NO: 834494 - DNA, 20 bp, mouse
gcggcggggctgtagctctt

SEQ ID NO: 834495 - DNA, 20 bp, mouse
gcgagggcgggcccgacggc

SEQ ID NO: 834496 - DNA, 20 bp, mouse
gagaccctggtggagccagg

SEQ ID NO: 834497 - DNA, 20 bp, mouse
ggaagagccaagcgaggggg

SEQ ID NO: 834498 - DNA, 20 bp, mouse
gaccaggaagagccaagcga

SEQ ID NO: 834499 - DNA, 20 bp, mouse
gtgaggtcgcaccacggtca

SEQ ID NO: 834500 - DNA, 20 bp, mouse
ggggctgaggcgagttgcgg

SEQ ID NO: 834501 - DNA, 20 bp, mouse
gcaaccgggctgccgcggcg

SEQ ID NO: 834502 - DNA, 20 bp, mouse
gaaagtacaaatgcgacggg

SEQ ID NO: 834503 - DNA, 20 bp, mouse
gaggcggcgggaggccacag

SEQ ID NO: 834504 - DNA, 20 bp, mouse
gagggaggcagctcgccacc

SEQ ID NO: 834505 - DNA, 20 bp, mouse
ggccagaccctggtggagcc

SEQ ID NO: 834506 - DNA, 20 bp, mouse
gccgtcctcacggaggtcta

SEQ ID NO: 834507 - DNA, 20 bp, mouse
gagaccagctaacgcccaca

SEQ ID NO: 834508 - DNA, 20 bp, mouse
gagagctcgaggtcctgctg

SEQ ID NO: 834509 - DNA, 20 bp, mouse
gccacgcgtggccgtcctca

SEQ ID NO: 834510 - DNA, 20 bp, mouse
gcctcacggaggtctagggg

SEQ ID NO: 834511 - DNA, 20 bp, mouse
gtctcagtggggatgtgcta

SEQ ID NO: 834512 - DNA, 20 bp, mouse
gcgcgtggccgtcctcacgg

SEQ ID NO: 834513 - DNA, 20 bp, mouse
gcgagcgaagagtccaaatt

SEQ ID NO: 834514 - DNA, 20 bp, mouse
ggggatgtgctagggcacaa

SEQ ID NO: 834515 - DNA, 20 bp, mouse
gcagccttgtgggcgttagc

SEQ ID NO: 834516 - DNA, 20 bp, mouse
gtccgtggcgggagattccc

SEQ ID NO: 834517 - DNA, 20 bp, mouse
gcgcactcacggagaacccc

SEQ ID NO: 834518 - DNA, 20 bp, mouse
ggccaagcgggggtccgtgg

SEQ ID NO: 834519 - DNA, 20 bp, mouse
gtgttaacgcggtacggtgg

SEQ ID NO: 834520 - DNA, 20 bp, mouse
gagggaggcgctgtcgggga

SEQ ID NO: 834521 - DNA, 20 bp, mouse
ggcggggccttgccaagcgg

SEQ ID NO: 834522 - DNA, 20 bp, mouse
ggtagagcctcggggaatgg

SEQ ID NO: 834523 - DNA, 20 bp, mouse
gcggcagcgcgtgggggagg

SEQ ID NO: 834524 - DNA, 20 bp, mouse
ggcaggcgcagcgtgcgggg

SEQ ID NO: 834525 - DNA, 20 bp, mouse
gcgtaccgcgttaacagcct

SEQ ID NO: 834526 - DNA, 20 bp, mouse
ggcacaaggctgccgctccc

SEQ ID NO: 834527 - DNA, 20 bp, mouse
gtagcactgtgccacaccct

SEQ ID NO: 834528 - DNA, 20 bp, mouse
gggctgccgctccctggctg

SEQ ID NO: 834529 - DNA, 20 bp, mouse
gcagccttgtgcattcgcga

SEQ ID NO: 834530 - DNA, 20 bp, mouse
gaacccgggctagataagca

SEQ ID NO: 834531 - DNA, 20 bp, mouse
gccaacgctgctctgacctg

SEQ ID NO: 834532 - DNA, 20 bp, mouse
gctgacctgtgggggaaccc

SEQ ID NO: 834533 - DNA, 20 bp, mouse
gctgcggtttgcaacaactg

SEQ ID NO: 834534 - DNA, 20 bp, mouse
ggcaaaccgcagccagggag

SEQ ID NO: 834535 - DNA, 20 bp, mouse
gcatgcccggatatggtcct

SEQ ID NO: 834536 - DNA, 20 bp, mouse
ggaagcggaaaggggacccg

SEQ ID NO: 834537 - DNA, 20 bp, mouse
gaggccacgggaagcggaaa

SEQ ID NO: 834538 - DNA, 20 bp, mouse
gtgacgcccggctggtgctg

SEQ ID NO: 834539 - DNA, 20 bp, mouse
gggcagaagagtgaggcgga

SEQ ID NO: 834540 - DNA, 20 bp, mouse
gcaccagccgggcgtcacgg

SEQ ID NO: 834541 - DNA, 20 bp, mouse
gggcggggcacgcgcagagg

SEQ ID NO: 834542 - DNA, 20 bp, mouse
gccgcccctcgggcccaagg

SEQ ID NO: 834543 - DNA, 20 bp, mouse
gtctcaggcaacggaggcct

SEQ ID NO: 834544 - DNA, 20 bp, mouse
gggctggtgctgcggatgag

SEQ ID NO: 834545 - DNA, 20 bp, mouse
gcgaggtacccgcgtctctc

SEQ ID NO: 834546 - DNA, 20 bp, mouse
gccgcagccgccacccctag

SEQ ID NO: 834547 - DNA, 20 bp, mouse
gacgccggcctcactcggta

SEQ ID NO: 834548 - DNA, 20 bp, mouse
gcaaccgcgccgtgacaatc

SEQ ID NO: 834549 - DNA, 20 bp, mouse
gacccctagcggcggagccc

SEQ ID NO: 834550 - DNA, 20 bp, mouse
ggggcggggcggcagggact

SEQ ID NO: 834551 - DNA, 20 bp, mouse
gccgccccgccctcctatcc

SEQ ID NO: 834552 - DNA, 20 bp, mouse
gggactgggcggggccacgc

SEQ ID NO: 834553 - DNA, 20 bp, mouse
ggctccgccgctaggggtgg

SEQ ID NO: 834554 - DNA, 20 bp, mouse
gcggcggagcccgggatagg

SEQ ID NO: 834555 - DNA, 20 bp, mouse
gccaccctctggcctcacgc

SEQ ID NO: 834556 - DNA, 20 bp, mouse
gagacagggcgctgtcgcgt

SEQ ID NO: 834557 - DNA, 20 bp, mouse
gcagggcgctgtcgcgtggg

SEQ ID NO: 834558 - DNA, 20 bp, mouse
gagcactcgctagggtacca

SEQ ID NO: 834559 - DNA, 20 bp, mouse
gacaaggcggtgccacgcta

SEQ ID NO: 834560 - DNA, 20 bp, mouse
gttgcactgaacgaaccttc

SEQ ID NO: 834561 - DNA, 20 bp, mouse
ggcacgtaggcgtccgtgac

SEQ ID NO: 834562 - DNA, 20 bp, mouse
ggtggcaccgccttgtgggc

SEQ ID NO: 834563 - DNA, 20 bp, mouse
gtctggtcccgcccacaagg

SEQ ID NO: 834564 - DNA, 20 bp, mouse
gagtgctcaaatgttccgga

SEQ ID NO: 834565 - DNA, 20 bp, mouse
gacggtactgacaagtcaga

SEQ ID NO: 834566 - DNA, 20 bp, mouse
gagactgcggacccaggata

SEQ ID NO: 834567 - DNA, 20 bp, mouse
gtgctaggttaccacgcacg

SEQ ID NO: 834568 - DNA, 20 bp, mouse
gctagcaaccaggcgtcgca

SEQ ID NO: 834569 - DNA, 20 bp, mouse
gccacgcacgcgggaaacaa

SEQ ID NO: 834570 - DNA, 20 bp, mouse
ggactcaccgaggaggctgc

SEQ ID NO: 834571 - DNA, 20 bp, mouse
gggaaatactactacagcaa

SEQ ID NO: 834572 - DNA, 20 bp, mouse
gcctgggtaaactgtcatgt

SEQ ID NO: 834573 - DNA, 20 bp, mouse
gcatatgctaaataaattag

SEQ ID NO: 834574 - DNA, 20 bp, mouse
gagctggagactgcggaccc

SEQ ID NO: 834575 - DNA, 20 bp, mouse
ggtagtagtatttcctgaca

SEQ ID NO: 834576 - DNA, 20 bp, mouse
gcgcctggggacgctcgagc

SEQ ID NO: 834577 - DNA, 20 bp, mouse
ggaggagcggaacgcgcctg

SEQ ID NO: 834578 - DNA, 20 bp, mouse
gagaaaggcgtaactcgcgc

SEQ ID NO: 834579 - DNA, 20 bp, mouse
gtcccggctcgagcgtcccc

SEQ ID NO: 834580 - DNA, 20 bp, mouse
gactcgcgcgggcagaggag

SEQ ID NO: 834581 - DNA, 20 bp, mouse
ggcgtaactcgcgcgggcag

SEQ ID NO: 834582 - DNA, 20 bp, mouse
ggacaacaccagagcgagcc

SEQ ID NO: 834583 - DNA, 20 bp, mouse
ggcgacagcagctaccggaa

SEQ ID NO: 834584 - DNA, 20 bp, mouse
ggacggtcctacacccaatg

SEQ ID NO: 834585 - DNA, 20 bp, mouse
gagcagctaccggaaggggc

SEQ ID NO: 834586 - DNA, 20 bp, mouse
gttcctgagtgcaggaaaat

SEQ ID NO: 834587 - DNA, 20 bp, mouse
gggagggaagcattcaaaaa

SEQ ID NO: 834588 - DNA, 20 bp, mouse
gttcatgcatgtgcccactc

SEQ ID NO: 834589 - DNA, 20 bp, mouse
ggagtgcaggaaaatgggtc

SEQ ID NO: 834590 - DNA, 20 bp, mouse
gcaggaaaatgggtccggat

SEQ ID NO: 834591 - DNA, 20 bp, mouse
gctaggaggagacttggagt

SEQ ID NO: 834592 - DNA, 20 bp, mouse
gcccactcaggcgagaggct

SEQ ID NO: 834593 - DNA, 20 bp, mouse
gatgtgcccactcaggcgag

SEQ ID NO: 834594 - DNA, 20 bp, mouse
gctcccagcacctatactgt

SEQ ID NO: 834595 - DNA, 20 bp, mouse
gtccccacagtataggtgct

SEQ ID NO: 834596 - DNA, 20 bp, mouse
gcgtgcgcagaaaatgcggc

SEQ ID NO: 834597 - DNA, 20 bp, mouse
gcgcgcgtgcgcagaaaatg

SEQ ID NO: 834598 - DNA, 20 bp, mouse
gcgaccaaatactaggaatt

SEQ ID NO: 834599 - DNA, 20 bp, mouse
gactccctgcttaagatgat

SEQ ID NO: 834600 - DNA, 20 bp, mouse
gcggccgcgtgttccgttta

SEQ ID NO: 834601 - DNA, 20 bp, mouse
ggtgcaaggacagagtgtgt

SEQ ID NO: 834602 - DNA, 20 bp, mouse
ggcaaccttctccacctggt

SEQ ID NO: 834603 - DNA, 20 bp, mouse
ggagcctcatcgctcttgtg

SEQ ID NO: 834604 - DNA, 20 bp, mouse
ggaagcccatcatcttaagc

SEQ ID NO: 834605 - DNA, 20 bp, mouse
gcaaccgaattcctagtatt

SEQ ID NO: 834606 - DNA, 20 bp, mouse
gtagccagaaaatgtcaaac

SEQ ID NO: 834607 - DNA, 20 bp, mouse
gccactgatgcgatcgtgac

SEQ ID NO: 834608 - DNA, 20 bp, mouse
gccctgcctctagttcggaa

SEQ ID NO: 834609 - DNA, 20 bp, mouse
gatcttcttgaccatcagaa

SEQ ID NO: 834610 - DNA, 20 bp, mouse
gccatacattgtgatcattg

SEQ ID NO: 834611 - DNA, 20 bp, mouse
gatggagttgacctgactct

SEQ ID NO: 834612 - DNA, 20 bp, mouse
ggttgcctgttcccttctga

SEQ ID NO: 834613 - DNA, 20 bp, mouse
gtgctgccctgcctctagtt

SEQ ID NO: 834614 - DNA, 20 bp, mouse
gaaatgtcaaacaggaaaca

SEQ ID NO: 834615 - DNA, 20 bp, mouse
gcatcaacgctatcaagttc

SEQ ID NO: 834616 - DNA, 20 bp, mouse
gcacacgcagatctgggcta

SEQ ID NO: 834617 - DNA, 20 bp, mouse
gcctggagcggcttcggctc

SEQ ID NO: 834618 - DNA, 20 bp, mouse
ggcctgagatcataccgatt

SEQ ID NO: 834619 - DNA, 20 bp, mouse
ggcctagcctggagcggctt

SEQ ID NO: 834620 - DNA, 20 bp, mouse
gccctaatcggtatgatctc

SEQ ID NO: 834621 - DNA, 20 bp, mouse
ggccgctccaggctaggcca

SEQ ID NO: 834622 - DNA, 20 bp, mouse
gagaggccaagcccttccct

SEQ ID NO: 834623 - DNA, 20 bp, mouse
gggccaagcccttccctagg

SEQ ID NO: 834624 - DNA, 20 bp, mouse
gttcttggaacagcctccta

SEQ ID NO: 834625 - DNA, 20 bp, mouse
gacagctaattgccaactcc

SEQ ID NO: 834626 - DNA, 20 bp, mouse
gtggctgcactagaagcagg

SEQ ID NO: 834627 - DNA, 20 bp, mouse
gctagaagcaggtggatgag

SEQ ID NO: 834628 - DNA, 20 bp, mouse
gaggccagagctcgaagctc

SEQ ID NO: 834629 - DNA, 20 bp, mouse
gtcgagctctggcctctcta

SEQ ID NO: 834630 - DNA, 20 bp, mouse
gctgtggctgcactagaagc

SEQ ID NO: 834631 - DNA, 20 bp, mouse
gaggcaggtaaatgcttgga

SEQ ID NO: 834632 - DNA, 20 bp, mouse
gcccacccagcataacccag

SEQ ID NO: 834633 - DNA, 20 bp, mouse
ggggcggtgcccgccgaatc

SEQ ID NO: 834634 - DNA, 20 bp, mouse
gcaggtggatgagaggatgg

SEQ ID NO: 834635 - DNA, 20 bp, mouse
gtcccagaagagcaaaatcc

SEQ ID NO: 834636 - DNA, 20 bp, mouse
ggggcgaggcgaggaagggg

SEQ ID NO: 834637 - DNA, 20 bp, mouse
ggctcacgggcgccacgtga

SEQ ID NO: 834638 - DNA, 20 bp, mouse
gggacccagggtcctcttca

SEQ ID NO: 834639 - DNA, 20 bp, mouse
gagccatcgagccccacgca

SEQ ID NO: 834640 - DNA, 20 bp, mouse
gagggtctccccagaggcgg

SEQ ID NO: 834641 - DNA, 20 bp, mouse
gcgagacagaggtggctcta

SEQ ID NO: 834642 - DNA, 20 bp, mouse
ggcggggcgaggcgaggaag

SEQ ID NO: 834643 - DNA, 20 bp, mouse
gcggagtatcatccttgcgt

SEQ ID NO: 834644 - DNA, 20 bp, mouse
gcagaaatagaggtgggtag

SEQ ID NO: 834645 - DNA, 20 bp, mouse
gagcccgcggcgctgggtac

SEQ ID NO: 834646 - DNA, 20 bp, mouse
gcctactggaaggactctac

SEQ ID NO: 834647 - DNA, 20 bp, mouse
gtgcacccttactttcaaaa

SEQ ID NO: 834648 - DNA, 20 bp, mouse
gccagtaggcagattctgta

SEQ ID NO: 834649 - DNA, 20 bp, mouse
gaggcagattctgtagggca

SEQ ID NO: 834650 - DNA, 20 bp, mouse
gtgtctgaccagagcgggtg

SEQ ID NO: 834651 - DNA, 20 bp, mouse
gactggaaggactctacagg

SEQ ID NO: 834652 - DNA, 20 bp, mouse
gagcatcagggtataaaagt

SEQ ID NO: 834653 - DNA, 20 bp, mouse
ggtgtggacttaatgtattc

SEQ ID NO: 834654 - DNA, 20 bp, mouse
gttggagacacaggcaaggg

SEQ ID NO: 834655 - DNA, 20 bp, mouse
gccctgatgcttccctgagc

SEQ ID NO: 834656 - DNA, 20 bp, mouse
gaggggacacggattcactg

SEQ ID NO: 834657 - DNA, 20 bp, mouse
gggggccgaaaaggtctcat

SEQ ID NO: 834658 - DNA, 20 bp, mouse
gagtggaggcgaacagcagg

SEQ ID NO: 834659 - DNA, 20 bp, mouse
ggtcaccttggccagagtgg

SEQ ID NO: 834660 - DNA, 20 bp, mouse
ggcgctggcggcaggtctat

SEQ ID NO: 834661 - DNA, 20 bp, mouse
ggggagccggcctgcggtct

SEQ ID NO: 834662 - DNA, 20 bp, mouse
ggggatcactcagcttgagg

SEQ ID NO: 834663 - DNA, 20 bp, mouse
gcccgcagggagccggcctg

SEQ ID NO: 834664 - DNA, 20 bp, mouse
ggaacagcagggggccgaaa

SEQ ID NO: 834665 - DNA, 20 bp, mouse
ggtctcattggaaggggaca

SEQ ID NO: 834666 - DNA, 20 bp, mouse
gtcggctcggaggtattcgg

SEQ ID NO: 834667 - DNA, 20 bp, mouse
gaactcggctcggaggtatt

SEQ ID NO: 834668 - DNA, 20 bp, mouse
gctcccgtccggcaatactc

SEQ ID NO: 834669 - DNA, 20 bp, mouse
gactgaggctccggagaact

SEQ ID NO: 834670 - DNA, 20 bp, mouse
gggagctttcggatagaagg

SEQ ID NO: 834671 - DNA, 20 bp, mouse
gctcccgagtattgccggac

SEQ ID NO: 834672 - DNA, 20 bp, mouse
gcgaaagccgaacccacacg

SEQ ID NO: 834673 - DNA, 20 bp, mouse
gtgcagcgagcgtccgacag

SEQ ID NO: 834674 - DNA, 20 bp, mouse
gacctccgagccgagttctc

SEQ ID NO: 834675 - DNA, 20 bp, mouse
gcgaagatggcgggagggtg

SEQ ID NO: 834676 - DNA, 20 bp, mouse
gctcagagactcaagtagta

SEQ ID NO: 834677 - DNA, 20 bp, mouse
ggagctcttctgtgctgcgg

SEQ ID NO: 834678 - DNA, 20 bp, mouse
gagtagcaagcagacagatt

SEQ ID NO: 834679 - DNA, 20 bp, mouse
gcagctatgatgctaaagat

SEQ ID NO: 834680 - DNA, 20 bp, mouse
gtcattgttcgcatcaatga

SEQ ID NO: 834681 - DNA, 20 bp, mouse
gttaatgaaaacagtcacat

SEQ ID NO: 834682 - DNA, 20 bp, mouse
gaatagagcagaccagagtc

SEQ ID NO: 834683 - DNA, 20 bp, mouse
gactaacaaagatccttgga

SEQ ID NO: 834684 - DNA, 20 bp, mouse
gtagaggttctagccttcca

SEQ ID NO: 834685 - DNA, 20 bp, mouse
gcagtgctaggcattcaggg

SEQ ID NO: 834686 - DNA, 20 bp, mouse
gttgcccttgagacctgaat

SEQ ID NO: 834687 - DNA, 20 bp, mouse
gccagcgcggacccggtcgg

SEQ ID NO: 834688 - DNA, 20 bp, mouse
gccgaagagggacttccgga

SEQ ID NO: 834689 - DNA, 20 bp, mouse
gacaggggagggactaggaa

SEQ ID NO: 834690 - DNA, 20 bp, mouse
gtgtctctagaggacagggg

SEQ ID NO: 834691 - DNA, 20 bp, mouse
gagtgcgggccacacctgag

SEQ ID NO: 834692 - DNA, 20 bp, mouse
ggcggggagcagctctgctt

SEQ ID NO: 834693 - DNA, 20 bp, mouse
gctgtccccgctagacttca

SEQ ID NO: 834694 - DNA, 20 bp, mouse
gcaggtgagctggccgaaga

SEQ ID NO: 834695 - DNA, 20 bp, mouse
gggaaagggtcaaaggcctg

SEQ ID NO: 834696 - DNA, 20 bp, mouse
gagggcatcccggaacgtga

SEQ ID NO: 834697 - DNA, 20 bp, mouse
gcctaagaggcgtggcctga

SEQ ID NO: 834698 - DNA, 20 bp, mouse
gggggtcgccgtcacgttcc

SEQ ID NO: 834699 - DNA, 20 bp, mouse
ggaaacagagggagcccggc

SEQ ID NO: 834700 - DNA, 20 bp, mouse
ggaggcttcggcccgttcat

SEQ ID NO: 834701 - DNA, 20 bp, mouse
gtcgctgtgctccgggtcag

SEQ ID NO: 834702 - DNA, 20 bp, mouse
gtcctcccacccccgggcgt

SEQ ID NO: 834703 - DNA, 20 bp, mouse
gaacgggccgaagcctcgta

SEQ ID NO: 834704 - DNA, 20 bp, mouse
gcacgcctccctaagaggcg

SEQ ID NO: 834705 - DNA, 20 bp, mouse
gtgaaggccacgcccacgcc

SEQ ID NO: 834706 - DNA, 20 bp, mouse
gggactctggggctgataac

SEQ ID NO: 834707 - DNA, 20 bp, mouse
gcccccagcacttagaaacc

SEQ ID NO: 834708 - DNA, 20 bp, mouse
gtgctgataaggtacccatc

SEQ ID NO: 834709 - DNA, 20 bp, mouse
gtgtctggcacttgctgata

SEQ ID NO: 834710 - DNA, 20 bp, mouse
gggtacccatcaggcaccaa

SEQ ID NO: 834711 - DNA, 20 bp, mouse
gacaatgggagttccacttt

SEQ ID NO: 834712 - DNA, 20 bp, mouse
gggagggggctcacttttgg

SEQ ID NO: 834713 - DNA, 20 bp, mouse
ggtagccctacaaccaaccc

SEQ ID NO: 834714 - DNA, 20 bp, mouse
gtatcagccccagagtccac

SEQ ID NO: 834715 - DNA, 20 bp, mouse
gggtggcccttggtgcctga

SEQ ID NO: 834716 - DNA, 20 bp, mouse
ggccacgatcgcagggaaac

SEQ ID NO: 834717 - DNA, 20 bp, mouse
ggggcgctctgagcgtctgt

SEQ ID NO: 834718 - DNA, 20 bp, mouse
gacctccaggccacgatcgc

SEQ ID NO: 834719 - DNA, 20 bp, mouse
ggggacgagccggaagaagg

SEQ ID NO: 834720 - DNA, 20 bp, mouse
gacgatcgcagggaaacagg

SEQ ID NO: 834721 - DNA, 20 bp, mouse
ggcagtagactcaaagtttc

SEQ ID NO: 834722 - DNA, 20 bp, mouse
gacttggaaaggatgagggg

SEQ ID NO: 834723 - DNA, 20 bp, mouse
gagtagcgccggaagagggt

SEQ ID NO: 834724 - DNA, 20 bp, mouse
ggtgaactagcagagttttg

SEQ ID NO: 834725 - DNA, 20 bp, mouse
gccctgcgatcgtggcctgg

SEQ ID NO: 834726 - DNA, 20 bp, mouse
gaggtggggccgggtggagg

SEQ ID NO: 834727 - DNA, 20 bp, mouse
gggaaccgaggaagtgtgga

SEQ ID NO: 834728 - DNA, 20 bp, mouse
gtgaaggggcgtgcccacga

SEQ ID NO: 834729 - DNA, 20 bp, mouse
ggggaaacccgcccacggag

SEQ ID NO: 834730 - DNA, 20 bp, mouse
gagcacgggcgtgaatgcgg

SEQ ID NO: 834731 - DNA, 20 bp, mouse
ggaggcggggctgagaaggt

SEQ ID NO: 834732 - DNA, 20 bp, mouse
gcggggccaagaccttaatt

SEQ ID NO: 834733 - DNA, 20 bp, mouse
gcacgaggggaacgagagca

SEQ ID NO: 834734 - DNA, 20 bp, mouse
ggtcttgggctgaagcggat

SEQ ID NO: 834735 - DNA, 20 bp, mouse
gccgtgggcgggtttccctc

SEQ ID NO: 834736 - DNA, 20 bp, mouse
gtaggcatccccatcctaag

SEQ ID NO: 834737 - DNA, 20 bp, mouse
gaggggctccccacctccgg

SEQ ID NO: 834738 - DNA, 20 bp, mouse
gatcctaaggggcagactgt

SEQ ID NO: 834739 - DNA, 20 bp, mouse
gagggcgatgcagcctccgg

SEQ ID NO: 834740 - DNA, 20 bp, mouse
ggtgaagcatatcagttgaa

SEQ ID NO: 834741 - DNA, 20 bp, mouse
gaagcccccctctgcccctg

SEQ ID NO: 834742 - DNA, 20 bp, mouse
gaggaggggctccccacctc

SEQ ID NO: 834743 - DNA, 20 bp, mouse
ggcgatgcagcctccggagg

SEQ ID NO: 834744 - DNA, 20 bp, mouse
gttgaagggtcgaggagcta

SEQ ID NO: 834745 - DNA, 20 bp, mouse
gggaatgcggctctgggatt

SEQ ID NO: 834746 - DNA, 20 bp, mouse
gaagtgcaggggctagtact

SEQ ID NO: 834747 - DNA, 20 bp, mouse
gcagataaggggaagtgcag

SEQ ID NO: 834748 - DNA, 20 bp, mouse
gtcacctggtgtcagataag

SEQ ID NO: 834749 - DNA, 20 bp, mouse
gagggccccagtgctcagat

SEQ ID NO: 834750 - DNA, 20 bp, mouse
gtatgctcccatcatctgaa

SEQ ID NO: 834751 - DNA, 20 bp, mouse
gtcccagttctcccaaacaa

SEQ ID NO: 834752 - DNA, 20 bp, mouse
ggagtgattcacagcatgac

SEQ ID NO: 834753 - DNA, 20 bp, mouse
gaccaggtgacttcatgttg

SEQ ID NO: 834754 - DNA, 20 bp, mouse
gactgcaactgctgttaatt

SEQ ID NO: 834755 - DNA, 20 bp, mouse
gggtagtacccggcacagag

SEQ ID NO: 834756 - DNA, 20 bp, mouse
ggcagcagggtgcttagatt

SEQ ID NO: 834757 - DNA, 20 bp, mouse
gattagggaaggatgatagg

SEQ ID NO: 834758 - DNA, 20 bp, mouse
gtagattagggaaggatgat

SEQ ID NO: 834759 - DNA, 20 bp, mouse
gggaaggatgataggagggt

SEQ ID NO: 834760 - DNA, 20 bp, mouse
ggcagcagcaggttccagct

SEQ ID NO: 834761 - DNA, 20 bp, mouse
gggagaacattggaccctaa

SEQ ID NO: 834762 - DNA, 20 bp, mouse
gggtgagggaggtctgagtg

SEQ ID NO: 834763 - DNA, 20 bp, mouse
gctagccgagtggagaacat

SEQ ID NO: 834764 - DNA, 20 bp, mouse
ggggtccaatgttctccact

SEQ ID NO: 834765 - DNA, 20 bp, mouse
ggtggcagttgctagccgag

SEQ ID NO: 834766 - DNA, 20 bp, mouse
ggcggtgaggcttgagacag

SEQ ID NO: 834767 - DNA, 20 bp, mouse
ggacccagggccgggcggtg

SEQ ID NO: 834768 - DNA, 20 bp, mouse
ggcttgagacagaggctcta

SEQ ID NO: 834769 - DNA, 20 bp, mouse
gccacatctcccagtgaacg

SEQ ID NO: 834770 - DNA, 20 bp, mouse
gcgcagcaggcttcagttag

SEQ ID NO: 834771 - DNA, 20 bp, mouse
ggagacagaggctctaaggt

SEQ ID NO: 834772 - DNA, 20 bp, mouse
gctaaggtaggcagcgcagc

SEQ ID NO: 834773 - DNA, 20 bp, mouse
gtgggagatgtggacctgag

SEQ ID NO: 834774 - DNA, 20 bp, mouse
ggggaggaacacggcccgag

SEQ ID NO: 834775 - DNA, 20 bp, mouse
ggctgtgcagacctaggaat

SEQ ID NO: 834776 - DNA, 20 bp, mouse
gttcctgaggaattccccca

SEQ ID NO: 834777 - DNA, 20 bp, mouse
gtcccaggatgaacatggca

SEQ ID NO: 834778 - DNA, 20 bp, mouse
gtatttgggtcacacatcag

SEQ ID NO: 834779 - DNA, 20 bp, mouse
ggatgtgtgacccaaatagt

SEQ ID NO: 834780 - DNA, 20 bp, mouse
gggtaggaggtcacattcat

SEQ ID NO: 834781 - DNA, 20 bp, mouse
gaccctgatagaaaatgacc

SEQ ID NO: 834782 - DNA, 20 bp, mouse
gggagggcttaagtgctctg

SEQ ID NO: 834783 - DNA, 20 bp, mouse
gccaaggagctgtaaaaaga

SEQ ID NO: 834784 - DNA, 20 bp, mouse
gggccagcagctggtaaaga

SEQ ID NO: 834785 - DNA, 20 bp, mouse
gcaacagctgatgtaccatg

SEQ ID NO: 834786 - DNA, 20 bp, mouse
gacaaacaaagcactctagg

SEQ ID NO: 834787 - DNA, 20 bp, mouse
gtcccggaggcttacaatct

SEQ ID NO: 834788 - DNA, 20 bp, mouse
gcactctaggaggagttgaa

SEQ ID NO: 834789 - DNA, 20 bp, mouse
gaggcttacaatctagggag

SEQ ID NO: 834790 - DNA, 20 bp, mouse
gaggagttgaacggacccac

SEQ ID NO: 834791 - DNA, 20 bp, mouse
gcttcagttttcagtaggaa

SEQ ID NO: 834792 - DNA, 20 bp, mouse
gcaccttctcttggtcccgg

SEQ ID NO: 834793 - DNA, 20 bp, mouse
gggagcctgctgatcagtgg

SEQ ID NO: 834794 - DNA, 20 bp, mouse
gccaccccttcagcatctat

SEQ ID NO: 834795 - DNA, 20 bp, mouse
gggtggagcctgctgatcag

SEQ ID NO: 834796 - DNA, 20 bp, mouse
gaaacctgatggttggaaca

SEQ ID NO: 834797 - DNA, 20 bp, mouse
gccctcccgggtcgctgcgg

SEQ ID NO: 834798 - DNA, 20 bp, mouse
ggctacttagaattgttctg

SEQ ID NO: 834799 - DNA, 20 bp, mouse
ggaggctgaaacctgatggt

SEQ ID NO: 834800 - DNA, 20 bp, mouse
gccagccccgcagcgagctg

SEQ ID NO: 834801 - DNA, 20 bp, mouse
gctgggacccccagaatcgg

SEQ ID NO: 834802 - DNA, 20 bp, mouse
gagcagcttctcccttaaag

SEQ ID NO: 834803 - DNA, 20 bp, mouse
gagggggcctccgattctgg

SEQ ID NO: 834804 - DNA, 20 bp, mouse
gtaaagaggctgaaacctga

SEQ ID NO: 834805 - DNA, 20 bp, mouse
ggccccctcccgggtcgctg

SEQ ID NO: 834806 - DNA, 20 bp, mouse
gcaggggaactgagctaaca

SEQ ID NO: 834807 - DNA, 20 bp, mouse
gaaaacaaaaacacttgtgg

SEQ ID NO: 834808 - DNA, 20 bp, mouse
gttcaggcctgcgtgagcag

SEQ ID NO: 834809 - DNA, 20 bp, mouse
gtagaagagggcctcattac

SEQ ID NO: 834810 - DNA, 20 bp, mouse
gggctgaccggtgcaagttg

SEQ ID NO: 834811 - DNA, 20 bp, mouse
gcatattggcaattgaattt

SEQ ID NO: 834812 - DNA, 20 bp, mouse
gtcagttcccctgctcacgc

SEQ ID NO: 834813 - DNA, 20 bp, mouse
gagatttgcttcctcccaga

SEQ ID NO: 834814 - DNA, 20 bp, mouse
gttgtttttaaatttaatcc

SEQ ID NO: 834815 - DNA, 20 bp, mouse
gttaaatagaggatagagca

SEQ ID NO: 834816 - DNA, 20 bp, mouse
gcccctgggcccccaagaac

SEQ ID NO: 834817 - DNA, 20 bp, mouse
gctaaaacgtatctctagga

SEQ ID NO: 834818 - DNA, 20 bp, mouse
gctctaggacggataaatca

SEQ ID NO: 834819 - DNA, 20 bp, mouse
ggacatgaagggtcagaatc

SEQ ID NO: 834820 - DNA, 20 bp, mouse
ggtggctctaccggagccga

SEQ ID NO: 834821 - DNA, 20 bp, mouse
ggaggctaaaacgtatctct

SEQ ID NO: 834822 - DNA, 20 bp, mouse
gttgtcttacccctcggctc

SEQ ID NO: 834823 - DNA, 20 bp, mouse
gtatgcctgcgctgccacgt

SEQ ID NO: 834824 - DNA, 20 bp, mouse
gagagttgggagagtcgggg

SEQ ID NO: 834825 - DNA, 20 bp, mouse
ggtgggaaggatagcatttc

SEQ ID NO: 834826 - DNA, 20 bp, mouse
ggtggcccgcccatatagcg

SEQ ID NO: 834827 - DNA, 20 bp, mouse
gtctgagcggtccacgtcgg

SEQ ID NO: 834828 - DNA, 20 bp, mouse
gctggcccggggtcccaata

SEQ ID NO: 834829 - DNA, 20 bp, mouse
gctatatgggcgggccacga

SEQ ID NO: 834830 - DNA, 20 bp, mouse
gggctctgagcggtccacgt

SEQ ID NO: 834831 - DNA, 20 bp, mouse
ggaagcggctcgtgagtggg

SEQ ID NO: 834832 - DNA, 20 bp, mouse
gatagccccgctatatgggc

SEQ ID NO: 834833 - DNA, 20 bp, mouse
gacagaagcggctcgtgagt

SEQ ID NO: 834834 - DNA, 20 bp, mouse
gtcacacaggccgtacctat

SEQ ID NO: 834835 - DNA, 20 bp, mouse
gctgctgggagtaccgcgtg

SEQ ID NO: 834836 - DNA, 20 bp, mouse
gcccctggccgcctggggat

SEQ ID NO: 834837 - DNA, 20 bp, mouse
gggagacagtcactgacgat

SEQ ID NO: 834838 - DNA, 20 bp, mouse
gcatcctgccctggcttccg

SEQ ID NO: 834839 - DNA, 20 bp, mouse
gtcccgggacgccaatcccc

SEQ ID NO: 834840 - DNA, 20 bp, mouse
gccctccagctggacagcct

SEQ ID NO: 834841 - DNA, 20 bp, mouse
gcgggacgccaatccccagg

SEQ ID NO: 834842 - DNA, 20 bp, mouse
gggacggcggcgcctggcag

SEQ ID NO: 834843 - DNA, 20 bp, mouse
gtccgtgggtgcacgtggag

SEQ ID NO: 834844 - DNA, 20 bp, mouse
gacccctccacgtgcaccca

SEQ ID NO: 834845 - DNA, 20 bp, mouse
gggcaaggcacagagaagtg

SEQ ID NO: 834846 - DNA, 20 bp, mouse
gggccccgggggtgcactaa

SEQ ID NO: 834847 - DNA, 20 bp, mouse
gccatccccgggaactgcga

SEQ ID NO: 834848 - DNA, 20 bp, mouse
gggaactgcgaaggccgaga

SEQ ID NO: 834849 - DNA, 20 bp, mouse
gaaagcctccgccccggaaa

SEQ ID NO: 834850 - DNA, 20 bp, mouse
gcgggtgtggcttccactag

SEQ ID NO: 834851 - DNA, 20 bp, mouse
ggattcgccagctctggccg

SEQ ID NO: 834852 - DNA, 20 bp, mouse
gggcgaatcctgcaccccaa

SEQ ID NO: 834853 - DNA, 20 bp, mouse
gcccggggatggggttcacc

SEQ ID NO: 834854 - DNA, 20 bp, mouse
gtcggccttcgcagttcccg

SEQ ID NO: 834855 - DNA, 20 bp, mouse
gcatgcggatctagtcccgc

SEQ ID NO: 834856 - DNA, 20 bp, mouse
gcggccatgaagcccagagg

SEQ ID NO: 834857 - DNA, 20 bp, mouse
ggtagcgtgaagccacatcc

SEQ ID NO: 834858 - DNA, 20 bp, mouse
gggaccgtgcccatcaagtc

SEQ ID NO: 834859 - DNA, 20 bp, mouse
ggcgccgaggcccagacctc

SEQ ID NO: 834860 - DNA, 20 bp, mouse
gagaggcggctggtaactaa

SEQ ID NO: 834861 - DNA, 20 bp, mouse
gcggctctggtcgctcccgg

SEQ ID NO: 834862 - DNA, 20 bp, mouse
gctcccggaggtctgggcct

SEQ ID NO: 834863 - DNA, 20 bp, mouse
gcgcgtccctcagttgagaa

SEQ ID NO: 834864 - DNA, 20 bp, mouse
gtggtcgctcccggaggtct

SEQ ID NO: 834865 - DNA, 20 bp, mouse
gcgcccagacggaaggacgg

SEQ ID NO: 834866 - DNA, 20 bp, mouse
gggcggggcgcggagaggaa

SEQ ID NO: 834867 - DNA, 20 bp, mouse
gcggagctgcgcggccactc

SEQ ID NO: 834868 - DNA, 20 bp, mouse
ggcaccgcggcgcaaagcgc

SEQ ID NO: 834869 - DNA, 20 bp, mouse
gcccgcgcgaacaacacctc

SEQ ID NO: 834870 - DNA, 20 bp, mouse
gggtaagagcgcgcgtcggt

SEQ ID NO: 834871 - DNA, 20 bp, mouse
ggtcacgagccctccatctt

SEQ ID NO: 834872 - DNA, 20 bp, mouse
ggcgctccgcactgctgcta

SEQ ID NO: 834873 - DNA, 20 bp, mouse
gaagctgagaccgaagatgg

SEQ ID NO: 834874 - DNA, 20 bp, mouse
gcgaacaacacctcggggcg

SEQ ID NO: 834875 - DNA, 20 bp, mouse
ggggcggccacgggaccggg

SEQ ID NO: 834876 - DNA, 20 bp, mouse
gggagtgtaccgttataact

SEQ ID NO: 834877 - DNA, 20 bp, mouse
gtgagtcaccccagttataa

SEQ ID NO: 834878 - DNA, 20 bp, mouse
gggaaaaaaacttccctagt

SEQ ID NO: 834879 - DNA, 20 bp, mouse
gtaactggggtgactcactt

SEQ ID NO: 834880 - DNA, 20 bp, mouse
gagttagggccacctgagaa

SEQ ID NO: 834881 - DNA, 20 bp, mouse
gtgggtaccaggttcacaag

SEQ ID NO: 834882 - DNA, 20 bp, mouse
gtgacacatttctccccact

SEQ ID NO: 834883 - DNA, 20 bp, mouse
gtatagacatagatatcaga

SEQ ID NO: 834884 - DNA, 20 bp, mouse
ggtctctctcgggtcatatt

SEQ ID NO: 834885 - DNA, 20 bp, mouse
ggaatgactttgctcagtta

SEQ ID NO: 834886 - DNA, 20 bp, mouse
gccggaggcaggggaatgtg

SEQ ID NO: 834887 - DNA, 20 bp, mouse
gcaccccagccccggaggca

SEQ ID NO: 834888 - DNA, 20 bp, mouse
gtgctctaccaggggcgaca

SEQ ID NO: 834889 - DNA, 20 bp, mouse
gcactcgctattaggatcta

SEQ ID NO: 834890 - DNA, 20 bp, mouse
gggcgcggtgacagcagaac

SEQ ID NO: 834891 - DNA, 20 bp, mouse
gaatagcgagtgttgctccc

SEQ ID NO: 834892 - DNA, 20 bp, mouse
ggcgagtgttgctcccaggc

SEQ ID NO: 834893 - DNA, 20 bp, mouse
gttccctggcggccgcgggt

SEQ ID NO: 834894 - DNA, 20 bp, mouse
gggacaggttgcctcttcaa

SEQ ID NO: 834895 - DNA, 20 bp, mouse
ggccgcgggtgggaagccgg

SEQ ID NO: 834896 - DNA, 20 bp, mouse
gcgggcaaagggtcctgtct

SEQ ID NO: 834897 - DNA, 20 bp, mouse
gaggctctgtggactggctc

SEQ ID NO: 834898 - DNA, 20 bp, mouse
gcagctgcggcccgggcaaa

SEQ ID NO: 834899 - DNA, 20 bp, mouse
gaaagggtcctgtctcggag

SEQ ID NO: 834900 - DNA, 20 bp, mouse
gtcattgggagacgcagctg

SEQ ID NO: 834901 - DNA, 20 bp, mouse
ggcgtctcccaatgacgcga

SEQ ID NO: 834902 - DNA, 20 bp, mouse
gctgggaagcgtagttctgg

SEQ ID NO: 834903 - DNA, 20 bp, mouse
ggggagacgcagctgcggcc

SEQ ID NO: 834904 - DNA, 20 bp, mouse
gtggagctgcgatcaacagg

SEQ ID NO: 834905 - DNA, 20 bp, mouse
gaatgacgcgatggcctcgc

SEQ ID NO: 834906 - DNA, 20 bp, mouse
gcacgggcaggtacatatac

SEQ ID NO: 834907 - DNA, 20 bp, mouse
gcacgcgcgtgcgtactcgt

SEQ ID NO: 834908 - DNA, 20 bp, mouse
ggaagggtgttgttataaga

SEQ ID NO: 834909 - DNA, 20 bp, mouse
ggtacctgcccgtgaccctc

SEQ ID NO: 834910 - DNA, 20 bp, mouse
gggacctggtcctttacaat

SEQ ID NO: 834911 - DNA, 20 bp, mouse
gacagcgcggtcgggtttag

SEQ ID NO: 834912 - DNA, 20 bp, mouse
ggggtgcggctccatacata

SEQ ID NO: 834913 - DNA, 20 bp, mouse
gctgcccgtgaccctctgga

SEQ ID NO: 834914 - DNA, 20 bp, mouse
gaacacccttcccattgtaa

SEQ ID NO: 834915 - DNA, 20 bp, mouse
gaggctttctaccttccaga

SEQ ID NO: 834916 - DNA, 20 bp, mouse
gtcagggctgggcaaggtat

SEQ ID NO: 834917 - DNA, 20 bp, mouse
gagggaaagaggacatgtca

SEQ ID NO: 834918 - DNA, 20 bp, mouse
gcagccctgagagcctctag

SEQ ID NO: 834919 - DNA, 20 bp, mouse
gactctgcttgcagggaaag

SEQ ID NO: 834920 - DNA, 20 bp, mouse
gctggccactagaggctctc

SEQ ID NO: 834921 - DNA, 20 bp, mouse
ggagaatcagatgactccta

SEQ ID NO: 834922 - DNA, 20 bp, mouse
ggacatgtcatggctgatac

SEQ ID NO: 834923 - DNA, 20 bp, mouse
gtgacaggggacactaagat

SEQ ID NO: 834924 - DNA, 20 bp, mouse
gagaactggtaccctaccgt

SEQ ID NO: 834925 - DNA, 20 bp, mouse
ggagtcatctgattctccac

SEQ ID NO: 834926 - DNA, 20 bp, mouse
ggagccgcccagccaatggg

SEQ ID NO: 834927 - DNA, 20 bp, mouse
gtatcagcgtccgaggggaa

SEQ ID NO: 834928 - DNA, 20 bp, mouse
ggcggggcccgctgtttcct

SEQ ID NO: 834929 - DNA, 20 bp, mouse
ggaggaagcgcgccacccat

SEQ ID NO: 834930 - DNA, 20 bp, mouse
gcgccgcggcgcagggcgag

SEQ ID NO: 834931 - DNA, 20 bp, mouse
gataagggatgggcggtact

SEQ ID NO: 834932 - DNA, 20 bp, mouse
gaacgcgcgccgccattggc

SEQ ID NO: 834933 - DNA, 20 bp, mouse
ggacgctgataagggatggg

SEQ ID NO: 834934 - DNA, 20 bp, mouse
gcacaagctagtgcgtgggg

SEQ ID NO: 834935 - DNA, 20 bp, mouse
gcaccggagaagcctcgtcc

SEQ ID NO: 834936 - DNA, 20 bp, mouse
gaggggctggccattcacag

SEQ ID NO: 834937 - DNA, 20 bp, mouse
gcggaaggaaacacagttgt

SEQ ID NO: 834938 - DNA, 20 bp, mouse
gggctgaaggcccctgtgaa

SEQ ID NO: 834939 - DNA, 20 bp, mouse
ggagcaatgatgaagttcag

SEQ ID NO: 834940 - DNA, 20 bp, mouse
gtccctgctcagttcttttc

SEQ ID NO: 834941 - DNA, 20 bp, mouse
gcagaagttgccagagggaa

SEQ ID NO: 834942 - DNA, 20 bp, mouse
ggtgctagggagagttttag

SEQ ID NO: 834943 - DNA, 20 bp, mouse
gggggtgccgccattccgga

SEQ ID NO: 834944 - DNA, 20 bp, mouse
gaatgttagaccacgtgcta

SEQ ID NO: 834945 - DNA, 20 bp, mouse
gttcaggggtgccgccattc

SEQ ID NO: 834946 - DNA, 20 bp, mouse
gacagaagactcagcccata

SEQ ID NO: 834947 - DNA, 20 bp, mouse
ggttgggagtatgtttgctc

SEQ ID NO: 834948 - DNA, 20 bp, mouse
gtaggaatgtgcaaggatta

SEQ ID NO: 834949 - DNA, 20 bp, mouse
gcaaactatttcttttatgt

SEQ ID NO: 834950 - DNA, 20 bp, mouse
gtttctctaggctgccatat

SEQ ID NO: 834951 - DNA, 20 bp, mouse
gtctactcctggaagaaata

SEQ ID NO: 834952 - DNA, 20 bp, mouse
gtaaggtaacttactgtaag

SEQ ID NO: 834953 - DNA, 20 bp, mouse
gaagaaagtggttccaggta

SEQ ID NO: 834954 - DNA, 20 bp, mouse
gagaaataatcgtgcaattc

SEQ ID NO: 834955 - DNA, 20 bp, mouse
gtacagtaagttaccttacc

SEQ ID NO: 834956 - DNA, 20 bp, mouse
gtcagcacagagactctccc

SEQ ID NO: 834957 - DNA, 20 bp, mouse
gtgaatcagtgctctgactc

SEQ ID NO: 834958 - DNA, 20 bp, mouse
gacaggtgtggtaacaactg

SEQ ID NO: 834959 - DNA, 20 bp, mouse
gatacgtgttagtttctccg

SEQ ID NO: 834960 - DNA, 20 bp, mouse
gaaatctagaatacaaacaa

SEQ ID NO: 834961 - DNA, 20 bp, mouse
gttagtgtgacagtagtttt

SEQ ID NO: 834962 - DNA, 20 bp, mouse
gaaattacaggtgaaaagta

SEQ ID NO: 834963 - DNA, 20 bp, mouse
gggtaaatgtgctagctaca

SEQ ID NO: 834964 - DNA, 20 bp, mouse
gctgaggatctgtagcttag

SEQ ID NO: 834965 - DNA, 20 bp, mouse
gaatcagtgaaagctgttat

SEQ ID NO: 834966 - DNA, 20 bp, mouse
gcatatcagcccatttgggg

SEQ ID NO: 834967 - DNA, 20 bp, mouse
gtttgcacgcccccccaaat

SEQ ID NO: 834968 - DNA, 20 bp, mouse
gtcaggagggacttcatgga

SEQ ID NO: 834969 - DNA, 20 bp, mouse
gagccactggctgttcacag

SEQ ID NO: 834970 - DNA, 20 bp, mouse
gcatggttgcaagagagtta

SEQ ID NO: 834971 - DNA, 20 bp, mouse
gttgcaagagagttatgggt

SEQ ID NO: 834972 - DNA, 20 bp, mouse
gttcatggaaggatgataca

SEQ ID NO: 834973 - DNA, 20 bp, mouse
gttagggcttcaagagccac

SEQ ID NO: 834974 - DNA, 20 bp, mouse
gcagatactaatggaaggtt

SEQ ID NO: 834975 - DNA, 20 bp, mouse
gttcccctgtgaacagccag

SEQ ID NO: 834976 - DNA, 20 bp, mouse
gggattgtttctggtttgta

SEQ ID NO: 834977 - DNA, 20 bp, mouse
ggtggtccagaataaaagat

SEQ ID NO: 834978 - DNA, 20 bp, mouse
gcactgagatatgtggtcac

SEQ ID NO: 834979 - DNA, 20 bp, mouse
ggagccaatagtgtgacttg

SEQ ID NO: 834980 - DNA, 20 bp, mouse
gaaaacgacactgagatatg

SEQ ID NO: 834981 - DNA, 20 bp, mouse
gggaccacaagtcacactat

SEQ ID NO: 834982 - DNA, 20 bp, mouse
gagtgaataaacatgactct

SEQ ID NO: 834983 - DNA, 20 bp, mouse
gatgtggtcacggggttgtg

SEQ ID NO: 834984 - DNA, 20 bp, mouse
gaggcaggacacattgttat

SEQ ID NO: 834985 - DNA, 20 bp, mouse
gcactacttaccagaataaa

SEQ ID NO: 834986 - DNA, 20 bp, mouse
gtcgccaaggcttgtcagac

SEQ ID NO: 834987 - DNA, 20 bp, mouse
gtgactgagacactttttat

SEQ ID NO: 834988 - DNA, 20 bp, mouse
gacagtctctacactcgcca

SEQ ID NO: 834989 - DNA, 20 bp, mouse
gttgtcagactggttctcta

SEQ ID NO: 834990 - DNA, 20 bp, mouse
gcttcactggaagagccagg

SEQ ID NO: 834991 - DNA, 20 bp, mouse
gggctttgtaggctaaagtg

SEQ ID NO: 834992 - DNA, 20 bp, mouse
gtaaaccacagtttcttcac

SEQ ID NO: 834993 - DNA, 20 bp, mouse
gggactcaaaagcaatcatc

SEQ ID NO: 834994 - DNA, 20 bp, mouse
ggaaccagtctgacaagcct

SEQ ID NO: 834995 - DNA, 20 bp, mouse
gtaagcactttctaggagta

SEQ ID NO: 834996 - DNA, 20 bp, mouse
ggacagtggtacttacaggc

SEQ ID NO: 834997 - DNA, 20 bp, mouse
ggattacgagtcaatcaaaa

SEQ ID NO: 834998 - DNA, 20 bp, mouse
gtggctgagtcagaggtaaa

SEQ ID NO: 834999 - DNA, 20 bp, mouse
gtgtagcctgaacttatgat

SEQ ID NO: 835000 - DNA, 20 bp, mouse
gtaatccatggctgagtcag

SEQ ID NO: 835001 - DNA, 20 bp, mouse
gctgaacttatgattggcta

SEQ ID NO: 835002 - DNA, 20 bp, mouse
gttgattgactcgtaatcca

SEQ ID NO: 835003 - DNA, 20 bp, mouse
gaatcaaggtgttacttctg

SEQ ID NO: 835004 - DNA, 20 bp, mouse
ggttaagtctaagaacagaa

SEQ ID NO: 835005 - DNA, 20 bp, mouse
gtaatgacagtggtacttac

SEQ ID NO: 835006 - DNA, 20 bp, mouse
gtcagtacacgtctggtctc

SEQ ID NO: 835007 - DNA, 20 bp, mouse
gaaacaatgtcaagttccaa

SEQ ID NO: 835008 - DNA, 20 bp, mouse
gaaagcttccccacgagtca

SEQ ID NO: 835009 - DNA, 20 bp, mouse
gtccccaggcacctgaaact

SEQ ID NO: 835010 - DNA, 20 bp, mouse
gaagcaactcccttgactcg

SEQ ID NO: 835011 - DNA, 20 bp, mouse
gaagagtatggtttgaggta

SEQ ID NO: 835012 - DNA, 20 bp, mouse
gcaagggagttgcttaccct

SEQ ID NO: 835013 - DNA, 20 bp, mouse
gtaccagaccggaggtagag

SEQ ID NO: 835014 - DNA, 20 bp, mouse
gtaaatgttaaccaagagta

SEQ ID NO: 835015 - DNA, 20 bp, mouse
gaatgaacgcatatgcccta

SEQ ID NO: 835016 - DNA, 20 bp, mouse
ggaaggcctccccacactca

SEQ ID NO: 835017 - DNA, 20 bp, mouse
gtaggaagatgagcgtgaga

SEQ ID NO: 835018 - DNA, 20 bp, mouse
ggggatgtcgcaggctcagg

SEQ ID NO: 835019 - DNA, 20 bp, mouse
gtggcccagcagaggatttc

SEQ ID NO: 835020 - DNA, 20 bp, mouse
gagatgagcgtgagagggga

SEQ ID NO: 835021 - DNA, 20 bp, mouse
gcacctacttcgtacaccca

SEQ ID NO: 835022 - DNA, 20 bp, mouse
gtccgggatgtcgcaggctc

SEQ ID NO: 835023 - DNA, 20 bp, mouse
gcacagccctgagtgtgggg

SEQ ID NO: 835024 - DNA, 20 bp, mouse
gatccgtgggtgtacgaagt

SEQ ID NO: 835025 - DNA, 20 bp, mouse
ggtcctcacagccctgagtg

SEQ ID NO: 835026 - DNA, 20 bp, mouse
gtctgggaggggcggtgaag

SEQ ID NO: 835027 - DNA, 20 bp, mouse
gatgggaagcccttcgaatg

SEQ ID NO: 835028 - DNA, 20 bp, mouse
gctcccagagggttccagac

SEQ ID NO: 835029 - DNA, 20 bp, mouse
ggggacgtgtgaggtaactc

SEQ ID NO: 835030 - DNA, 20 bp, mouse
gatcctgtctggaaccctct

SEQ ID NO: 835031 - DNA, 20 bp, mouse
ggatggggcggggaagtcgg

SEQ ID NO: 835032 - DNA, 20 bp, mouse
gagacaggatctgagattat

SEQ ID NO: 835033 - DNA, 20 bp, mouse
gtggggctgaaggacaggtc

SEQ ID NO: 835034 - DNA, 20 bp, mouse
gcaggtattagctgagtaac

SEQ ID NO: 835035 - DNA, 20 bp, mouse
ggaagtcggtgggacgtgtg

SEQ ID NO: 835036 - DNA, 20 bp, mouse
gggcagaaggttgatctgtt

SEQ ID NO: 835037 - DNA, 20 bp, mouse
ggtcttactagttctcaacg

SEQ ID NO: 835038 - DNA, 20 bp, mouse
gtagttctcaacgaggctaa

SEQ ID NO: 835039 - DNA, 20 bp, mouse
ggtgggaaaaaactaaatgc

SEQ ID NO: 835040 - DNA, 20 bp, mouse
gatgaacagtccatttgtca

SEQ ID NO: 835041 - DNA, 20 bp, mouse
gaccttagtcacagggcaga

SEQ ID NO: 835042 - DNA, 20 bp, mouse
gacagtccatttgtcagggt

SEQ ID NO: 835043 - DNA, 20 bp, mouse
gaccttctgccctgtgacta

SEQ ID NO: 835044 - DNA, 20 bp, mouse
ggatagacatattggtcatt

SEQ ID NO: 835045 - DNA, 20 bp, mouse
ggattgtaatttacagttgt

SEQ ID NO: 835046 - DNA, 20 bp, mouse
gaggaggaggagtttccccg

SEQ ID NO: 835047 - DNA, 20 bp, mouse
gggcacctcggccagaagga

SEQ ID NO: 835048 - DNA, 20 bp, mouse
gaagccaagagctcggacag

SEQ ID NO: 835049 - DNA, 20 bp, mouse
ggggtccgctggtccggagg

SEQ ID NO: 835050 - DNA, 20 bp, mouse
gccaggaaaggctgtccagg

SEQ ID NO: 835051 - DNA, 20 bp, mouse
gcagacccatgggaactcca

SEQ ID NO: 835052 - DNA, 20 bp, mouse
gcggaggcgggtcgctgcta

SEQ ID NO: 835053 - DNA, 20 bp, mouse
gtaggggaggagcgctccct

SEQ ID NO: 835054 - DNA, 20 bp, mouse
gaggagggaacggccaggaa

SEQ ID NO: 835055 - DNA, 20 bp, mouse
gcctcaagggtccgctggtc

SEQ ID NO: 835056 - DNA, 20 bp, mouse
ggtagtatgggcgcagagat

SEQ ID NO: 835057 - DNA, 20 bp, mouse
gcagaattataggagcgtca

SEQ ID NO: 835058 - DNA, 20 bp, mouse
gcaggtagccctggtagtat

SEQ ID NO: 835059 - DNA, 20 bp, mouse
gcagctgtaggactcaatca

SEQ ID NO: 835060 - DNA, 20 bp, mouse
gtgagcaaaggcagaattat

SEQ ID NO: 835061 - DNA, 20 bp, mouse
ggaagccagcggcatcaccg

SEQ ID NO: 835062 - DNA, 20 bp, mouse
gacttcaaagccaggagaga

SEQ ID NO: 835063 - DNA, 20 bp, mouse
ggacaaaagttggagaccag

SEQ ID NO: 835064 - DNA, 20 bp, mouse
gtgctgatgtggccttttgt

SEQ ID NO: 835065 - DNA, 20 bp, mouse
gttcagtgacggagtctgca

SEQ ID NO: 835066 - DNA, 20 bp, mouse
gaacacctggagtggttcat

SEQ ID NO: 835067 - DNA, 20 bp, mouse
gtaggcttgtgtaactcttt

SEQ ID NO: 835068 - DNA, 20 bp, mouse
gggagtggttcataggccta

SEQ ID NO: 835069 - DNA, 20 bp, mouse
gattggctgaggctagttga

SEQ ID NO: 835070 - DNA, 20 bp, mouse
gcaccagtgtactacaacta

SEQ ID NO: 835071 - DNA, 20 bp, mouse
gcatggcggtgcttttttgt

SEQ ID NO: 835072 - DNA, 20 bp, mouse
gacacccagtcgttaggggc

SEQ ID NO: 835073 - DNA, 20 bp, mouse
gggttcataggcctaaggac

SEQ ID NO: 835074 - DNA, 20 bp, mouse
gaggtgtgtcacctgtcctt

SEQ ID NO: 835075 - DNA, 20 bp, mouse
ggtgtcaggcattaggattg

SEQ ID NO: 835076 - DNA, 20 bp, mouse
gaacaagggggcctattcat

SEQ ID NO: 835077 - DNA, 20 bp, mouse
gcactgatcctctacaacaa

SEQ ID NO: 835078 - DNA, 20 bp, mouse
gttagcagatagcaggggct

SEQ ID NO: 835079 - DNA, 20 bp, mouse
gatgctcagggcccatgaat

SEQ ID NO: 835080 - DNA, 20 bp, mouse
gcagccctgtcagcaagaag

SEQ ID NO: 835081 - DNA, 20 bp, mouse
gtccagttagcagatagcag

SEQ ID NO: 835082 - DNA, 20 bp, mouse
ggagacaatgaactatgctc

SEQ ID NO: 835083 - DNA, 20 bp, mouse
ggttgtagaggatcagtgca

SEQ ID NO: 835084 - DNA, 20 bp, mouse
gataggcccccttgttgtag

SEQ ID NO: 835085 - DNA, 20 bp, mouse
gtcagtgcaagggctgggct

SEQ ID NO: 835086 - DNA, 20 bp, mouse
gcaccctgttaggggaccag

SEQ ID NO: 835087 - DNA, 20 bp, mouse
gaccaagcaacaggccccgg

SEQ ID NO: 835088 - DNA, 20 bp, mouse
ggggaccaggggctgtaacc

SEQ ID NO: 835089 - DNA, 20 bp, mouse
gagcccctggtcccctaaca

SEQ ID NO: 835090 - DNA, 20 bp, mouse
gagacctgagctctcccccg

SEQ ID NO: 835091 - DNA, 20 bp, mouse
ggtcccctaacagggtgaat

SEQ ID NO: 835092 - DNA, 20 bp, mouse
gcctgggcccgtgacttctg

SEQ ID NO: 835093 - DNA, 20 bp, mouse
ggccctggacctgacaggag

SEQ ID NO: 835094 - DNA, 20 bp, mouse
gggcctctcctgtcaggtcc

SEQ ID NO: 835095 - DNA, 20 bp, mouse
gtgccccatgggtgcccagg

SEQ ID NO: 835096 - DNA, 20 bp, mouse
gaggacacagagaggtcagt

SEQ ID NO: 835097 - DNA, 20 bp, mouse
ggcaggtcactgacaaggat

SEQ ID NO: 835098 - DNA, 20 bp, mouse
ggatggattgcctttccgat

SEQ ID NO: 835099 - DNA, 20 bp, mouse
ggtcaatatgttgggactga

SEQ ID NO: 835100 - DNA, 20 bp, mouse
gccaaggactcagttcctat

SEQ ID NO: 835101 - DNA, 20 bp, mouse
gacagcttcagtttctgaac

SEQ ID NO: 835102 - DNA, 20 bp, mouse
gtgcttcactgtaaagttaa

SEQ ID NO: 835103 - DNA, 20 bp, mouse
gcggaatcagcttaccaccc

SEQ ID NO: 835104 - DNA, 20 bp, mouse
gtttctgaactggacccggg

SEQ ID NO: 835105 - DNA, 20 bp, mouse
ggactcagttcctatcggaa

SEQ ID NO: 835106 - DNA, 20 bp, mouse
gtgggtccacatgggtgtca

SEQ ID NO: 835107 - DNA, 20 bp, mouse
gctgtgcatggcggtcacaa

SEQ ID NO: 835108 - DNA, 20 bp, mouse
gaggtctcccctgcagcccg

SEQ ID NO: 835109 - DNA, 20 bp, mouse
ggggtctgagtggccatttc

SEQ ID NO: 835110 - DNA, 20 bp, mouse
gggcagatcaagtctcctta

SEQ ID NO: 835111 - DNA, 20 bp, mouse
gctgtcccctctgctgtgca

SEQ ID NO: 835112 - DNA, 20 bp, mouse
gccaatttgtcccatcctta

SEQ ID NO: 835113 - DNA, 20 bp, mouse
gaccgccatgcacagcagag

SEQ ID NO: 835114 - DNA, 20 bp, mouse
gatcaagtctccttaaggat

SEQ ID NO: 835115 - DNA, 20 bp, mouse
ggggataccaggattagcaa

SEQ ID NO: 835116 - DNA, 20 bp, mouse
gggccacgccctcgttgcgg

SEQ ID NO: 835117 - DNA, 20 bp, mouse
gctctcgcccgccgcaacga

SEQ ID NO: 835118 - DNA, 20 bp, mouse
gcggccttggggcctaccct

SEQ ID NO: 835119 - DNA, 20 bp, mouse
gtcgcctgttgcaaccgaag

SEQ ID NO: 835120 - DNA, 20 bp, mouse
gccacgccctggggcttcgg

SEQ ID NO: 835121 - DNA, 20 bp, mouse
gaactggcccgaccccaccc

SEQ ID NO: 835122 - DNA, 20 bp, mouse
gtaggaacgcgggccgagaa

SEQ ID NO: 835123 - DNA, 20 bp, mouse
gccacccagggtaggcccca

SEQ ID NO: 835124 - DNA, 20 bp, mouse
ggcgcccgccagccataaac

SEQ ID NO: 835125 - DNA, 20 bp, mouse
ggtggggtcgggccagttta

SEQ ID NO: 835126 - DNA, 20 bp, mouse
gagagaggcccgtgactcat

SEQ ID NO: 835127 - DNA, 20 bp, mouse
gagtcacgggcctctctgat

SEQ ID NO: 835128 - DNA, 20 bp, mouse
gaggttctgaagttgaaccg

SEQ ID NO: 835129 - DNA, 20 bp, mouse
gggcggttatgtggcaagta

SEQ ID NO: 835130 - DNA, 20 bp, mouse
gtgtccagtcacagagtgat

SEQ ID NO: 835131 - DNA, 20 bp, mouse
gccgcccatcactctgtgac

SEQ ID NO: 835132 - DNA, 20 bp, mouse
ggattgccatccaatcagag

SEQ ID NO: 835133 - DNA, 20 bp, mouse
gcataaagctaaaagcatgg

SEQ ID NO: 835134 - DNA, 20 bp, mouse
gagctaaaagcatggtggtg

SEQ ID NO: 835135 - DNA, 20 bp, mouse
gacccataaagctaaaagca

SEQ ID NO: 835136 - DNA, 20 bp, mouse
gaaccccagggctaaagctg

SEQ ID NO: 835137 - DNA, 20 bp, mouse
gagccaagatgtgtccaatc

SEQ ID NO: 835138 - DNA, 20 bp, mouse
gaagactgcatttgtaaaga

SEQ ID NO: 835139 - DNA, 20 bp, mouse
gagaaggaattgtgaacccc

SEQ ID NO: 835140 - DNA, 20 bp, mouse
gtccctgattggacacatct

SEQ ID NO: 835141 - DNA, 20 bp, mouse
ggagtacataggcaatgttc

SEQ ID NO: 835142 - DNA, 20 bp, mouse
gacgtgagagtcagtggttc

SEQ ID NO: 835143 - DNA, 20 bp, mouse
gggcaatgttcaggaatgca

SEQ ID NO: 835144 - DNA, 20 bp, mouse
gatgcagacgtgagagtcag

SEQ ID NO: 835145 - DNA, 20 bp, mouse
gctacacaggcgtccctgat

SEQ ID NO: 835146 - DNA, 20 bp, mouse
gaaccccagggctaaagctg

SEQ ID NO: 835147 - DNA, 20 bp, mouse
gatgggcgggatataggggc

SEQ ID NO: 835148 - DNA, 20 bp, mouse
gagccaagatgtgtccaatc

SEQ ID NO: 835149 - DNA, 20 bp, mouse
gaagactgcatttgtaaaga

SEQ ID NO: 835150 - DNA, 20 bp, mouse
gagaaggaattgtgaacccc

SEQ ID NO: 835151 - DNA, 20 bp, mouse
gtccctgattggacacatct

SEQ ID NO: 835152 - DNA, 20 bp, mouse
ggagtacataggcaatgttc

SEQ ID NO: 835153 - DNA, 20 bp, mouse
gacgtgagagtcagtggttc

SEQ ID NO: 835154 - DNA, 20 bp, mouse
gggcaatgttcaggaatgca

SEQ ID NO: 835155 - DNA, 20 bp, mouse
gatgcagacgtgagagtcag

SEQ ID NO: 835156 - DNA, 20 bp, mouse
gaaccccagggctaaagctg

SEQ ID NO: 835157 - DNA, 20 bp, mouse
gatgggcgggatataggggc

SEQ ID NO: 835158 - DNA, 20 bp, mouse
gagccaagatgtgtccaatc

SEQ ID NO: 835159 - DNA, 20 bp, mouse
gaagactgcatttgtaaaga

SEQ ID NO: 835160 - DNA, 20 bp, mouse
gagaaggaattgtgaacccc

SEQ ID NO: 835161 - DNA, 20 bp, mouse
gtccctgattggacacatct

SEQ ID NO: 835162 - DNA, 20 bp, mouse
ggagtacataggcaatgttc

SEQ ID NO: 835163 - DNA, 20 bp, mouse
gacgtgagagtcagtggttc

SEQ ID NO: 835164 - DNA, 20 bp, mouse
gggcaatgttcaggaatgca

SEQ ID NO: 835165 - DNA, 20 bp, mouse
gatgcagacgtgagagtcag

SEQ ID NO: 835166 - DNA, 20 bp, mouse
gctggtgaatggggatgtgg

SEQ ID NO: 835167 - DNA, 20 bp, mouse
gtctccggaagggcgttcgg

SEQ ID NO: 835168 - DNA, 20 bp, mouse
gggcctgagtggcacctaag

SEQ ID NO: 835169 - DNA, 20 bp, mouse
ggcgctggtgaatggggatg

SEQ ID NO: 835170 - DNA, 20 bp, mouse
gtcaaaggcgctggtgaatg

SEQ ID NO: 835171 - DNA, 20 bp, mouse
gcgcctttgaaccacatcga

SEQ ID NO: 835172 - DNA, 20 bp, mouse
gcggcgcgaaggagttaagc

SEQ ID NO: 835173 - DNA, 20 bp, mouse
gggacacctcaccctatctt

SEQ ID NO: 835174 - DNA, 20 bp, mouse
gaaatagacgtcaaatgggg

SEQ ID NO: 835175 - DNA, 20 bp, mouse
gtcgcgccgcatctccggaa

SEQ ID NO: 835176 - DNA, 20 bp, mouse
gactcagcgccagctggtag

SEQ ID NO: 835177 - DNA, 20 bp, mouse
gccagagcgcgcaggtttag

SEQ ID NO: 835178 - DNA, 20 bp, mouse
gacacctggcctctaccagc

SEQ ID NO: 835179 - DNA, 20 bp, mouse
ggggtcgccgcagggcttga

SEQ ID NO: 835180 - DNA, 20 bp, mouse
gcgggcatgcgcagagtggg

SEQ ID NO: 835181 - DNA, 20 bp, mouse
gtggtagaggccaggtgttg

SEQ ID NO: 835182 - DNA, 20 bp, mouse
gaagcccaggggtgcatccc

SEQ ID NO: 835183 - DNA, 20 bp, mouse
gacctcaggtcccaggatcc

SEQ ID NO: 835184 - DNA, 20 bp, mouse
ggctgagaccggctggggac

SEQ ID NO: 835185 - DNA, 20 bp, mouse
gtgcgcagagtgggcggagg

SEQ ID NO: 835186 - DNA, 20 bp, mouse
gagagtggggccagagtacc

SEQ ID NO: 835187 - DNA, 20 bp, mouse
gctggagcagctagaagagt

SEQ ID NO: 835188 - DNA, 20 bp, mouse
ggagcagctagaagagtggg

SEQ ID NO: 835189 - DNA, 20 bp, mouse
gtggggccagagtaccaggc

SEQ ID NO: 835190 - DNA, 20 bp, mouse
gcagccagtgggggtagaca

SEQ ID NO: 835191 - DNA, 20 bp, mouse
gagacagggaggagtctgcg

SEQ ID NO: 835192 - DNA, 20 bp, mouse
gcactggagaggggtccggg

SEQ ID NO: 835193 - DNA, 20 bp, mouse
gaaggggccgggctagctta

SEQ ID NO: 835194 - DNA, 20 bp, mouse
gcctcccgggcgcacgactc

SEQ ID NO: 835195 - DNA, 20 bp, mouse
gactccaaaagctcccgcgt

SEQ ID NO: 835196 - DNA, 20 bp, mouse
gccctcatccacagtaagga

SEQ ID NO: 835197 - DNA, 20 bp, mouse
gactaggccccgggatacct

SEQ ID NO: 835198 - DNA, 20 bp, mouse
gctctccctcatccacagta

SEQ ID NO: 835199 - DNA, 20 bp, mouse
gagccgtaaagctttttcca

SEQ ID NO: 835200 - DNA, 20 bp, mouse
ggcgacgccgaactgcactc

SEQ ID NO: 835201 - DNA, 20 bp, mouse
gaagaccggaactaggcccc

SEQ ID NO: 835202 - DNA, 20 bp, mouse
gcgtgcaatgcgggagtctg

SEQ ID NO: 835203 - DNA, 20 bp, mouse
gcgtcgcggctgtgcatcct

SEQ ID NO: 835204 - DNA, 20 bp, mouse
gacgtagagtcctcatctca

SEQ ID NO: 835205 - DNA, 20 bp, mouse
gagtgcgcgaggaccgctct

SEQ ID NO: 835206 - DNA, 20 bp, mouse
gagagcgtgagtgatggaaa

SEQ ID NO: 835207 - DNA, 20 bp, mouse
ggcaaccgatggtcccgcgg

SEQ ID NO: 835208 - DNA, 20 bp, mouse
gaagaggagagcgtgagtga

SEQ ID NO: 835209 - DNA, 20 bp, mouse
gggcgggaggcgggactaga

SEQ ID NO: 835210 - DNA, 20 bp, mouse
gagagcgctcgccacgaagg

SEQ ID NO: 835211 - DNA, 20 bp, mouse
ggggcgggacgcggcggggt

SEQ ID NO: 835212 - DNA, 20 bp, mouse
gctcgccacgaaggaggcgc

SEQ ID NO: 835213 - DNA, 20 bp, mouse
gcctcccgccgcgggaccat

SEQ ID NO: 835214 - DNA, 20 bp, mouse
ggggaacagcggccaggccc

SEQ ID NO: 835215 - DNA, 20 bp, mouse
gtgcccctgcgcctccttcg

SEQ ID NO: 835216 - DNA, 20 bp, mouse
ggggcccatcgacgatccaa

SEQ ID NO: 835217 - DNA, 20 bp, mouse
gggcccacgggaaggaccct

SEQ ID NO: 835218 - DNA, 20 bp, mouse
ggggctggaccagatgttgc

SEQ ID NO: 835219 - DNA, 20 bp, mouse
gtccctgtgaacccacgtgc

SEQ ID NO: 835220 - DNA, 20 bp, mouse
gtggacaagcagaaacccca

SEQ ID NO: 835221 - DNA, 20 bp, mouse
gaggagggcgggaactaaac

SEQ ID NO: 835222 - DNA, 20 bp, mouse
ggcggcccgggagcattgtg

SEQ ID NO: 835223 - DNA, 20 bp, mouse
ggtacccttggatcgtcgat

SEQ ID NO: 835224 - DNA, 20 bp, mouse
gaaccccagggtccttcccg

SEQ ID NO: 835225 - DNA, 20 bp, mouse
gcaagggtaccggcaacatc

SEQ ID NO: 835226 - DNA, 20 bp, mouse
gtgcgccgcggcagaagggg

SEQ ID NO: 835227 - DNA, 20 bp, mouse
gaaagggccaggttgcgccg

SEQ ID NO: 835228 - DNA, 20 bp, mouse
gtccgtaggggtcaggggag

SEQ ID NO: 835229 - DNA, 20 bp, mouse
gagtcatgggagattaaagg

SEQ ID NO: 835230 - DNA, 20 bp, mouse
ggaaggggaggagtcattgt

SEQ ID NO: 835231 - DNA, 20 bp, mouse
gaggttgcgccgcggcagaa

SEQ ID NO: 835232 - DNA, 20 bp, mouse
ggatgacgcaaagctacgta

SEQ ID NO: 835233 - DNA, 20 bp, mouse
ggggaggagtcattgttggc

SEQ ID NO: 835234 - DNA, 20 bp, mouse
ggcaactcaggattctgtcc

SEQ ID NO: 835235 - DNA, 20 bp, mouse
ggacgcaaagctacgtaagg

SEQ ID NO: 835236 - DNA, 20 bp, mouse
gtcggagctcacgactgaag

SEQ ID NO: 835237 - DNA, 20 bp, mouse
gtgcctagggccagggtaaa

SEQ ID NO: 835238 - DNA, 20 bp, mouse
gagaaggggcggtaggcgga

SEQ ID NO: 835239 - DNA, 20 bp, mouse
gcctcctgcgggagatggag

SEQ ID NO: 835240 - DNA, 20 bp, mouse
gatctcccgcaggaggaaca

SEQ ID NO: 835241 - DNA, 20 bp, mouse
gccgggccctgttcctcctg

SEQ ID NO: 835242 - DNA, 20 bp, mouse
gaagaggcgcttgccggctg

SEQ ID NO: 835243 - DNA, 20 bp, mouse
gcccttctagggcttttcga

SEQ ID NO: 835244 - DNA, 20 bp, mouse
ggcggtaggcggagggatca

SEQ ID NO: 835245 - DNA, 20 bp, mouse
gtgaccttactaggcactgg

SEQ ID NO: 835246 - DNA, 20 bp, mouse
ggcggggcttagaatatctg

SEQ ID NO: 835247 - DNA, 20 bp, mouse
ggggccgaggttgccgtcga

SEQ ID NO: 835248 - DNA, 20 bp, mouse
ggcaggagcggataagtcga

SEQ ID NO: 835249 - DNA, 20 bp, mouse
gaccaagcgccctaggcttt

SEQ ID NO: 835250 - DNA, 20 bp, mouse
gtgaggggcagaagacacat

SEQ ID NO: 835251 - DNA, 20 bp, mouse
gggcgacggaagtaagttgc

SEQ ID NO: 835252 - DNA, 20 bp, mouse
gtctaagagtgtcccatcat

SEQ ID NO: 835253 - DNA, 20 bp, mouse
ggaattgccaggtgagtagt

SEQ ID NO: 835254 - DNA, 20 bp, mouse
gggaaaaaatccagtagtga

SEQ ID NO: 835255 - DNA, 20 bp, mouse
ggggacactcttagacgaag

SEQ ID NO: 835256 - DNA, 20 bp, mouse
gaaagagctcggaagagcgt

SEQ ID NO: 835257 - DNA, 20 bp, mouse
gtcttcccggaatgcacgta

SEQ ID NO: 835258 - DNA, 20 bp, mouse
gagagcgtgggaatccgtgc

SEQ ID NO: 835259 - DNA, 20 bp, mouse
gagcacacttgcgccgtcac

SEQ ID NO: 835260 - DNA, 20 bp, mouse
ggatcccggtagcccagcga

SEQ ID NO: 835261 - DNA, 20 bp, mouse
ggagcttagtgcttgaggtg

SEQ ID NO: 835262 - DNA, 20 bp, mouse
gttagtgcttgaggtgaggt

SEQ ID NO: 835263 - DNA, 20 bp, mouse
gaaaacatgtgacaaaactt

SEQ ID NO: 835264 - DNA, 20 bp, mouse
gcaagccatacgtgcattcc

SEQ ID NO: 835265 - DNA, 20 bp, mouse
ggggtaggccggcctccttc

SEQ ID NO: 835266 - DNA, 20 bp, mouse
gcccccaacgcactgtggga

SEQ ID NO: 835267 - DNA, 20 bp, mouse
gtgccgggcgggcagataag

SEQ ID NO: 835268 - DNA, 20 bp, mouse
gaagagcaggccgttgcctt

SEQ ID NO: 835269 - DNA, 20 bp, mouse
gtcggagcacggcgcagagg

SEQ ID NO: 835270 - DNA, 20 bp, mouse
gcacgcccccaacgcactgt

SEQ ID NO: 835271 - DNA, 20 bp, mouse
gtctgtgaaggcggttgctt

SEQ ID NO: 835272 - DNA, 20 bp, mouse
gtgcttgctgtttctctaaa

SEQ ID NO: 835273 - DNA, 20 bp, mouse
ggggcgtggccttgccgggc

SEQ ID NO: 835274 - DNA, 20 bp, mouse
ggcagtcggtaaaacagcat

SEQ ID NO: 835275 - DNA, 20 bp, mouse
gaaactgcagacggttgctt

SEQ ID NO: 835276 - DNA, 20 bp, mouse
gcaggcgcgccgccagctaa

SEQ ID NO: 835277 - DNA, 20 bp, mouse
gcagccctcccagcggaaca

SEQ ID NO: 835278 - DNA, 20 bp, mouse
gtaaccctgttccgctggga

SEQ ID NO: 835279 - DNA, 20 bp, mouse
gcaaatggtccgttagctgg

SEQ ID NO: 835280 - DNA, 20 bp, mouse
gaaaagtgggaaaggatgtc

SEQ ID NO: 835281 - DNA, 20 bp, mouse
gagcaagcccggggcagttc

SEQ ID NO: 835282 - DNA, 20 bp, mouse
gcttgggaactgggatatga

SEQ ID NO: 835283 - DNA, 20 bp, mouse
gactactctgcgggggcgga

SEQ ID NO: 835284 - DNA, 20 bp, mouse
gttcactaacaactactctg

SEQ ID NO: 835285 - DNA, 20 bp, mouse
gtgaaagacgcactcactcc

SEQ ID NO: 835286 - DNA, 20 bp, mouse
gaatcctggtggggacgacg

SEQ ID NO: 835287 - DNA, 20 bp, mouse
gaaaccgagacagaggtgta

SEQ ID NO: 835288 - DNA, 20 bp, mouse
gaaaccctctgcccccgcga

SEQ ID NO: 835289 - DNA, 20 bp, mouse
gaatctggggccaatcagga

SEQ ID NO: 835290 - DNA, 20 bp, mouse
gtggccctacacctctgtct

SEQ ID NO: 835291 - DNA, 20 bp, mouse
gggagaagaaaccgagacag

SEQ ID NO: 835292 - DNA, 20 bp, mouse
ggcagagggtttggaaagtt

SEQ ID NO: 835293 - DNA, 20 bp, mouse
gttgccacagaatcctggtg

SEQ ID NO: 835294 - DNA, 20 bp, mouse
gcaccaaggaagttttccga

SEQ ID NO: 835295 - DNA, 20 bp, mouse
gtccccgccctcttccccaa

SEQ ID NO: 835296 - DNA, 20 bp, mouse
gctggtgcttctggactcgg

SEQ ID NO: 835297 - DNA, 20 bp, mouse
gggggcggggactacgacac

SEQ ID NO: 835298 - DNA, 20 bp, mouse
gtggactcgggggtgacgtg

SEQ ID NO: 835299 - DNA, 20 bp, mouse
gccgcagagcgctgccgagg

SEQ ID NO: 835300 - DNA, 20 bp, mouse
gccagcaagcaccgcagggt

SEQ ID NO: 835301 - DNA, 20 bp, mouse
gcagcgcgcgagctagcagt

SEQ ID NO: 835302 - DNA, 20 bp, mouse
gggaaagagactacaagacc

SEQ ID NO: 835303 - DNA, 20 bp, mouse
ggtcggtagaagcttctctc

SEQ ID NO: 835304 - DNA, 20 bp, mouse
gtctctccggcaactgcaac

SEQ ID NO: 835305 - DNA, 20 bp, mouse
ggcggctcgtcaggtaggtc

SEQ ID NO: 835306 - DNA, 20 bp, mouse
ggggccgggccggtagagag

SEQ ID NO: 835307 - DNA, 20 bp, mouse
ggcccggcgagtccagtgtt

SEQ ID NO: 835308 - DNA, 20 bp, mouse
ggggccggtagagagagggg

SEQ ID NO: 835309 - DNA, 20 bp, mouse
gactgtgtgacgcgggacag

SEQ ID NO: 835310 - DNA, 20 bp, mouse
gtccgccagcggattttccg

SEQ ID NO: 835311 - DNA, 20 bp, mouse
ggcactccccagacctaagt

SEQ ID NO: 835312 - DNA, 20 bp, mouse
gtcgcaccacggtctctgat

SEQ ID NO: 835313 - DNA, 20 bp, mouse
gaggtgctgactgtgtgacg

SEQ ID NO: 835314 - DNA, 20 bp, mouse
ggcaaccgcggaaaatccgc

SEQ ID NO: 835315 - DNA, 20 bp, mouse
gcccccaacactggactcgc

SEQ ID NO: 835316 - DNA, 20 bp, mouse
gcaaaggggtggggtgctga

SEQ ID NO: 835317 - DNA, 20 bp, mouse
gcagccacagcaaaggggtg

SEQ ID NO: 835318 - DNA, 20 bp, mouse
gtggagcagccacagcaaag

SEQ ID NO: 835319 - DNA, 20 bp, mouse
ggggggagttaagggtcacg

SEQ ID NO: 835320 - DNA, 20 bp, mouse
gaagtggagcaactcggggc

SEQ ID NO: 835321 - DNA, 20 bp, mouse
ggaagcagaacacaagctga

SEQ ID NO: 835322 - DNA, 20 bp, mouse
gtaagggtcacgaggctgtg

SEQ ID NO: 835323 - DNA, 20 bp, mouse
gaacccgcagaccaagggag

SEQ ID NO: 835324 - DNA, 20 bp, mouse
gaccgtgcaagccactccct

SEQ ID NO: 835325 - DNA, 20 bp, mouse
ggtagctgacaaaaccagaa

SEQ ID NO: 835326 - DNA, 20 bp, mouse
gcccgcccggagaaactcct

SEQ ID NO: 835327 - DNA, 20 bp, mouse
gaaactcctaggtcccgccc

SEQ ID NO: 835328 - DNA, 20 bp, mouse
gacaccccggggcgggacct

SEQ ID NO: 835329 - DNA, 20 bp, mouse
gactcacgcggggacacccc

SEQ ID NO: 835330 - DNA, 20 bp, mouse
gcacatggatgtgacgtgga

SEQ ID NO: 835331 - DNA, 20 bp, mouse
gcgggacctaggagtttctc

SEQ ID NO: 835332 - DNA, 20 bp, mouse
gagcgccctctgccggtcgg

SEQ ID NO: 835333 - DNA, 20 bp, mouse
gacgcggggacaccccgggg

SEQ ID NO: 835334 - DNA, 20 bp, mouse
ggccacgcgggtcacgtgac

SEQ ID NO: 835335 - DNA, 20 bp, mouse
gccctccgcagggtcccgaa

SEQ ID NO: 835336 - DNA, 20 bp, mouse
gcatcccccgccctccgttc

SEQ ID NO: 835337 - DNA, 20 bp, mouse
gcaaccagaacggagggcgg

SEQ ID NO: 835338 - DNA, 20 bp, mouse
gcattggcaaccagaacgga

SEQ ID NO: 835339 - DNA, 20 bp, mouse
gcagagcagcggctggaatg

SEQ ID NO: 835340 - DNA, 20 bp, mouse
gtggcaaccagaacggaggg

SEQ ID NO: 835341 - DNA, 20 bp, mouse
gggaatgcggctgaaacatc

SEQ ID NO: 835342 - DNA, 20 bp, mouse
ggccaatgcaaatgagtcag

SEQ ID NO: 835343 - DNA, 20 bp, mouse
gccgcaacggaaagtgccat

SEQ ID NO: 835344 - DNA, 20 bp, mouse
gtaattgtgtaactccgcaa

SEQ ID NO: 835345 - DNA, 20 bp, mouse
gaaaaaaagccgaactccag

SEQ ID NO: 835346 - DNA, 20 bp, mouse
gctactgttccaacaggcta

SEQ ID NO: 835347 - DNA, 20 bp, mouse
ggtactagctaggtaggagt

SEQ ID NO: 835348 - DNA, 20 bp, mouse
gtgaatgaaggtctattaat

SEQ ID NO: 835349 - DNA, 20 bp, mouse
gggcagaatcttatctgagg

SEQ ID NO: 835350 - DNA, 20 bp, mouse
gactcgaagcacgctactta

SEQ ID NO: 835351 - DNA, 20 bp, mouse
ggcttttggcttgtgaaaag

SEQ ID NO: 835352 - DNA, 20 bp, mouse
gggaagtctactgttccaac

SEQ ID NO: 835353 - DNA, 20 bp, mouse
gttcggagagctagggaaca

SEQ ID NO: 835354 - DNA, 20 bp, mouse
gcttactgtgctaggcacat

SEQ ID NO: 835355 - DNA, 20 bp, mouse
ggtggattaggaaatcgtca

SEQ ID NO: 835356 - DNA, 20 bp, mouse
gcccgaggggccactgcggg

SEQ ID NO: 835357 - DNA, 20 bp, mouse
gtggtcgcctccacccgcag

SEQ ID NO: 835358 - DNA, 20 bp, mouse
gcgcccccgaggggccactg

SEQ ID NO: 835359 - DNA, 20 bp, mouse
gtgccctggacagaacgaat

SEQ ID NO: 835360 - DNA, 20 bp, mouse
ggcaggagtccgcccccgag

SEQ ID NO: 835361 - DNA, 20 bp, mouse
ggctgcgggagggattttca

SEQ ID NO: 835362 - DNA, 20 bp, mouse
gtccacccgcagtggcccct

SEQ ID NO: 835363 - DNA, 20 bp, mouse
gaatcgaatcgcgcggggct

SEQ ID NO: 835364 - DNA, 20 bp, mouse
gaatgggggcagacgtgcag

SEQ ID NO: 835365 - DNA, 20 bp, mouse
gcccccattcgttctgtcca

SEQ ID NO: 835366 - DNA, 20 bp, mouse
gatgacgcgggcgtgggcga

SEQ ID NO: 835367 - DNA, 20 bp, mouse
ggaggtgggaggcatgacgc

SEQ ID NO: 835368 - DNA, 20 bp, mouse
gaggccacgcccccgagaaa

SEQ ID NO: 835369 - DNA, 20 bp, mouse
ggcagcaagcctctgccagg

SEQ ID NO: 835370 - DNA, 20 bp, mouse
ggggaggcatgacgcgggcg

SEQ ID NO: 835371 - DNA, 20 bp, mouse
ggtggcgggaaagtgttgga

SEQ ID NO: 835372 - DNA, 20 bp, mouse
gtcagcaaatggtagcgcac

SEQ ID NO: 835373 - DNA, 20 bp, mouse
gggggcgagccctttctcgg

SEQ ID NO: 835374 - DNA, 20 bp, mouse
gagcgccggcgctattccgg

SEQ ID NO: 835375 - DNA, 20 bp, mouse
gtgcggccgggagattcctc

SEQ ID NO: 835376 - DNA, 20 bp, mouse
ggacagtgatgatgaaccgg

SEQ ID NO: 835377 - DNA, 20 bp, mouse
gccacctagaaataagacaa

SEQ ID NO: 835378 - DNA, 20 bp, mouse
gggaagcaccaactctgaag

SEQ ID NO: 835379 - DNA, 20 bp, mouse
ggaggtaggtgccaaggtta

SEQ ID NO: 835380 - DNA, 20 bp, mouse
gcacacctccacctaataaa

SEQ ID NO: 835381 - DNA, 20 bp, mouse
ggaggtggagagtagatagg

SEQ ID NO: 835382 - DNA, 20 bp, mouse
gctagaccaaagggcctctt

SEQ ID NO: 835383 - DNA, 20 bp, mouse
gaactctgaagtggcaagga

SEQ ID NO: 835384 - DNA, 20 bp, mouse
gaggccctagaaggtaagat

SEQ ID NO: 835385 - DNA, 20 bp, mouse
gaagaagcagaccttttatt

SEQ ID NO: 835386 - DNA, 20 bp, mouse
gtgcacgcgagggtagagtc

SEQ ID NO: 835387 - DNA, 20 bp, mouse
gcgccagtgcctgcacgcga

SEQ ID NO: 835388 - DNA, 20 bp, mouse
gtcaccaggctcccagacca

SEQ ID NO: 835389 - DNA, 20 bp, mouse
gctggtggcgagtagggtgt

SEQ ID NO: 835390 - DNA, 20 bp, mouse
gggggtgctggtggcgagta

SEQ ID NO: 835391 - DNA, 20 bp, mouse
ggtagagtccgggtgcgggg

SEQ ID NO: 835392 - DNA, 20 bp, mouse
gcgagggtagagtccgggtg

SEQ ID NO: 835393 - DNA, 20 bp, mouse
ggctcccagaccagggctct

SEQ ID NO: 835394 - DNA, 20 bp, mouse
gtcccccccaccagctcacc

SEQ ID NO: 835395 - DNA, 20 bp, mouse
gtaccctcgcgtgcaggcac

SEQ ID NO: 835396 - DNA, 20 bp, mouse
ggacacaagctgaaactcaa

SEQ ID NO: 835397 - DNA, 20 bp, mouse
gaaaacttgggagcagtcgc

SEQ ID NO: 835398 - DNA, 20 bp, mouse
gtgcgcgcgcaagcccgcgg

SEQ ID NO: 835399 - DNA, 20 bp, mouse
ggggtggggaaatccacctt

SEQ ID NO: 835400 - DNA, 20 bp, mouse
gctacctaatatgaaaactt

SEQ ID NO: 835401 - DNA, 20 bp, mouse
gtggggaaatccaccttggg

SEQ ID NO: 835402 - DNA, 20 bp, mouse
gcttgcgcgcgcaccgggca

SEQ ID NO: 835403 - DNA, 20 bp, mouse
gcgcgcaagcccgcggaggt

SEQ ID NO: 835404 - DNA, 20 bp, mouse
gaagttgttcagattctgtc

SEQ ID NO: 835405 - DNA, 20 bp, mouse
gcgcgcaccgggcaggggtg

SEQ ID NO: 835406 - DNA, 20 bp, mouse
gagcctggggacactcggac

SEQ ID NO: 835407 - DNA, 20 bp, mouse
gccgccgaccagctccgcca

SEQ ID NO: 835408 - DNA, 20 bp, mouse
ggtcacggcagcccacgctc

SEQ ID NO: 835409 - DNA, 20 bp, mouse
gccagggggtgcccgagcgt

SEQ ID NO: 835410 - DNA, 20 bp, mouse
gacaaggcagggtccactga

SEQ ID NO: 835411 - DNA, 20 bp, mouse
gcagaatgaggggaagtata

SEQ ID NO: 835412 - DNA, 20 bp, mouse
gaccccctggcggagctggt

SEQ ID NO: 835413 - DNA, 20 bp, mouse
ggtcctgtccgagtgtcccc

SEQ ID NO: 835414 - DNA, 20 bp, mouse
ggggcaccccctggcggagc

SEQ ID NO: 835415 - DNA, 20 bp, mouse
gcgcgggtctgaagcactcg

SEQ ID NO: 835416 - DNA, 20 bp, mouse
ggcgcggaggcgtgggacaa

SEQ ID NO: 835417 - DNA, 20 bp, mouse
ggggttaacgctttaggagc

SEQ ID NO: 835418 - DNA, 20 bp, mouse
gctgccctgaggctagccgc

SEQ ID NO: 835419 - DNA, 20 bp, mouse
gtggggagctacagaatctt

SEQ ID NO: 835420 - DNA, 20 bp, mouse
gagctgtgacctgtggtgag

SEQ ID NO: 835421 - DNA, 20 bp, mouse
gggatcctgcgcggaggcgt

SEQ ID NO: 835422 - DNA, 20 bp, mouse
ggtgggaggatcctgcgcgg

SEQ ID NO: 835423 - DNA, 20 bp, mouse
gtcggaactcccagaggcag

SEQ ID NO: 835424 - DNA, 20 bp, mouse
gggggctttgggacactccg

SEQ ID NO: 835425 - DNA, 20 bp, mouse
gtctgccagcggctagcctc

SEQ ID NO: 835426 - DNA, 20 bp, mouse
ggagtagggtagacacttgg

SEQ ID NO: 835427 - DNA, 20 bp, mouse
ggggtactcaagtttgcaga

SEQ ID NO: 835428 - DNA, 20 bp, mouse
gtacccacgatgtggagcga

SEQ ID NO: 835429 - DNA, 20 bp, mouse
ggctccgccccggaaggcgg

SEQ ID NO: 835430 - DNA, 20 bp, mouse
gttccttcgctccacatcgt

SEQ ID NO: 835431 - DNA, 20 bp, mouse
gccgcccccgccttccgggg

SEQ ID NO: 835432 - DNA, 20 bp, mouse
gaacttgagtacccacgatg

SEQ ID NO: 835433 - DNA, 20 bp, mouse
gagcgctccgccccggaagg

SEQ ID NO: 835434 - DNA, 20 bp, mouse
gtggctgttggggcgggccg

SEQ ID NO: 835435 - DNA, 20 bp, mouse
ggccagcgctccgccccgga

SEQ ID NO: 835436 - DNA, 20 bp, mouse
gggtaaaaggtgacatctgt

SEQ ID NO: 835437 - DNA, 20 bp, mouse
gggtctagctaagaatagag

SEQ ID NO: 835438 - DNA, 20 bp, mouse
ggatcaacctacatggtaaa

SEQ ID NO: 835439 - DNA, 20 bp, mouse
ggaggggagggtcttgttag

SEQ ID NO: 835440 - DNA, 20 bp, mouse
gatctgtcggtctgagagac

SEQ ID NO: 835441 - DNA, 20 bp, mouse
gctacagggcttgatgtggg

SEQ ID NO: 835442 - DNA, 20 bp, mouse
gtcttgttagaggcagaatg

SEQ ID NO: 835443 - DNA, 20 bp, mouse
gatgctgtgcctctgggtct

SEQ ID NO: 835444 - DNA, 20 bp, mouse
gtgaagagaatgattctaca

SEQ ID NO: 835445 - DNA, 20 bp, mouse
gatgtgggtggcaaactttg

SEQ ID NO: 835446 - DNA, 20 bp, mouse
gcctgctggggtgggaccac

SEQ ID NO: 835447 - DNA, 20 bp, mouse
gccgcccttgcctgctgggg

SEQ ID NO: 835448 - DNA, 20 bp, mouse
ggaaaaggtaggcggctaca

SEQ ID NO: 835449 - DNA, 20 bp, mouse
gtggggtgggaccactgggg

SEQ ID NO: 835450 - DNA, 20 bp, mouse
ggtcccaccccagcaggcaa

SEQ ID NO: 835451 - DNA, 20 bp, mouse
gggactctgcccaggaggta

SEQ ID NO: 835452 - DNA, 20 bp, mouse
gcttggaggcagatggttag

SEQ ID NO: 835453 - DNA, 20 bp, mouse
gcccagacctctttcacctg

SEQ ID NO: 835454 - DNA, 20 bp, mouse
ggaaacaattggtcttggtg

SEQ ID NO: 835455 - DNA, 20 bp, mouse
gcgccccgcccttgcctgct

SEQ ID NO: 835456 - DNA, 20 bp, mouse
ggcccctgagcgggactagg

SEQ ID NO: 835457 - DNA, 20 bp, mouse
gaatgtgctcagaagcgtat

SEQ ID NO: 835458 - DNA, 20 bp, mouse
gcatgacctcagccagtctg

SEQ ID NO: 835459 - DNA, 20 bp, mouse
ggcttcctcagcccacagac

SEQ ID NO: 835460 - DNA, 20 bp, mouse
ggaggatgggggctttgagt

SEQ ID NO: 835461 - DNA, 20 bp, mouse
gcaaaagctctcaacagcct

SEQ ID NO: 835462 - DNA, 20 bp, mouse
ggactacagggtagtatgct

SEQ ID NO: 835463 - DNA, 20 bp, mouse
gaacagcctaggtctgtagt

SEQ ID NO: 835464 - DNA, 20 bp, mouse
gtaagcgcaaggatgacaca

SEQ ID NO: 835465 - DNA, 20 bp, mouse
gccggtgagaggggtgagtt

SEQ ID NO: 835466 - DNA, 20 bp, mouse
gagggccacaggtattgtgg

SEQ ID NO: 835467 - DNA, 20 bp, mouse
gcgcccaagcctcttagaaa

SEQ ID NO: 835468 - DNA, 20 bp, mouse
gtaacagttgcaatgtggac

SEQ ID NO: 835469 - DNA, 20 bp, mouse
gaagagggccacaggtattg

SEQ ID NO: 835470 - DNA, 20 bp, mouse
gccaagcctcttagaaacgg

SEQ ID NO: 835471 - DNA, 20 bp, mouse
ggaccctgctgctcttaaga

SEQ ID NO: 835472 - DNA, 20 bp, mouse
gtgaaaggaggatcatctga

SEQ ID NO: 835473 - DNA, 20 bp, mouse
gaataggtggtttctgtttc

SEQ ID NO: 835474 - DNA, 20 bp, mouse
ggggaggacaagctataggc

SEQ ID NO: 835475 - DNA, 20 bp, mouse
gaagaacagcagattctctg

SEQ ID NO: 835476 - DNA, 20 bp, mouse
gttaggagatgtccagaaag

SEQ ID NO: 835477 - DNA, 20 bp, mouse
gaactccagcaaactcgccc

SEQ ID NO: 835478 - DNA, 20 bp, mouse
gtgaagcccagtctgagggg

SEQ ID NO: 835479 - DNA, 20 bp, mouse
gagttgggagaggcatgtag

SEQ ID NO: 835480 - DNA, 20 bp, mouse
ggatgtctgccggaaactgg

SEQ ID NO: 835481 - DNA, 20 bp, mouse
gggagaggcatgtaggggtt

SEQ ID NO: 835482 - DNA, 20 bp, mouse
gggcctgaagcccagtctga

SEQ ID NO: 835483 - DNA, 20 bp, mouse
gaacttcctggggcagaagg

SEQ ID NO: 835484 - DNA, 20 bp, mouse
gaggcagagacaaggcaagt

SEQ ID NO: 835485 - DNA, 20 bp, mouse
gctggctctcctagtttccc

SEQ ID NO: 835486 - DNA, 20 bp, mouse
gaccaacgcgactagaaatc

SEQ ID NO: 835487 - DNA, 20 bp, mouse
gacacactgcagggctgtcg

SEQ ID NO: 835488 - DNA, 20 bp, mouse
gtggctgggagggacacacc

SEQ ID NO: 835489 - DNA, 20 bp, mouse
gggacacaccaggactgctc

SEQ ID NO: 835490 - DNA, 20 bp, mouse
gtgcagggctgtcgcgggcg

SEQ ID NO: 835491 - DNA, 20 bp, mouse
gttacaggcccggagcacag

SEQ ID NO: 835492 - DNA, 20 bp, mouse
ggccactcagcgagatgaaa

SEQ ID NO: 835493 - DNA, 20 bp, mouse
gcaacgatccaggaccttac

SEQ ID NO: 835494 - DNA, 20 bp, mouse
gagtgtgtctcttggctggg

SEQ ID NO: 835495 - DNA, 20 bp, mouse
gcggcacggcatgatgtcat

SEQ ID NO: 835496 - DNA, 20 bp, mouse
gagagcctggggagaggcga

SEQ ID NO: 835497 - DNA, 20 bp, mouse
ggcaggcgggagttattagg

SEQ ID NO: 835498 - DNA, 20 bp, mouse
ggaagtgggtgagcttagac

SEQ ID NO: 835499 - DNA, 20 bp, mouse
gacggcaggcgggagttatt

SEQ ID NO: 835500 - DNA, 20 bp, mouse
gaagcaaaggagttctcggc

SEQ ID NO: 835501 - DNA, 20 bp, mouse
gggcgccaagctacgggacc

SEQ ID NO: 835502 - DNA, 20 bp, mouse
gtgccgtcccgtgagatagg

SEQ ID NO: 835503 - DNA, 20 bp, mouse
ggcctgccgtcccgtgagat

SEQ ID NO: 835504 - DNA, 20 bp, mouse
gggggaagggagagtggcgg

SEQ ID NO: 835505 - DNA, 20 bp, mouse
gtagcccgggtcccgtagct

SEQ ID NO: 835506 - DNA, 20 bp, mouse
gaggtggaggtgtcctgcga

SEQ ID NO: 835507 - DNA, 20 bp, mouse
ggcgaggactctgtgtaaag

SEQ ID NO: 835508 - DNA, 20 bp, mouse
ggccagggaatcacaggtgg

SEQ ID NO: 835509 - DNA, 20 bp, mouse
gagggcggcgggcgccatag

SEQ ID NO: 835510 - DNA, 20 bp, mouse
gcaggagctagggcagacca

SEQ ID NO: 835511 - DNA, 20 bp, mouse
gatagaagcgcattcattcc

SEQ ID NO: 835512 - DNA, 20 bp, mouse
gtgtgattccctggcatctc

SEQ ID NO: 835513 - DNA, 20 bp, mouse
gctcttccccaccactggaa

SEQ ID NO: 835514 - DNA, 20 bp, mouse
gagacacccttccagtggtg

SEQ ID NO: 835515 - DNA, 20 bp, mouse
ggtaaagaggcgtgtcctca

SEQ ID NO: 835516 - DNA, 20 bp, mouse
gaaggcgctccagaaaccga

SEQ ID NO: 835517 - DNA, 20 bp, mouse
gggcaccctctccttcccct

SEQ ID NO: 835518 - DNA, 20 bp, mouse
ggctccagaaaccgagggga

SEQ ID NO: 835519 - DNA, 20 bp, mouse
gggaaggagagggtgcccct

SEQ ID NO: 835520 - DNA, 20 bp, mouse
gaaagagcccggcctcctcc

SEQ ID NO: 835521 - DNA, 20 bp, mouse
gacacgtggtggcgccgaag

SEQ ID NO: 835522 - DNA, 20 bp, mouse
gggtgccccttggcgttagc

SEQ ID NO: 835523 - DNA, 20 bp, mouse
gtcctccagctaacgccaag

SEQ ID NO: 835524 - DNA, 20 bp, mouse
gaacttgcgcataatggcgc

SEQ ID NO: 835525 - DNA, 20 bp, mouse
gtaaagttaagtcggggtga

SEQ ID NO: 835526 - DNA, 20 bp, mouse
gtggccacgcctctcctcag

SEQ ID NO: 835527 - DNA, 20 bp, mouse
ggaaccaatccgctgaggag

SEQ ID NO: 835528 - DNA, 20 bp, mouse
ggagaggcatgaactattgt

SEQ ID NO: 835529 - DNA, 20 bp, mouse
gaatccgctgaggagaggcg

SEQ ID NO: 835530 - DNA, 20 bp, mouse
gcttcactgtcagggtctga

SEQ ID NO: 835531 - DNA, 20 bp, mouse
ggcttgcactcggccatgtt

SEQ ID NO: 835532 - DNA, 20 bp, mouse
ggcagcggcgtgcttgcact

SEQ ID NO: 835533 - DNA, 20 bp, mouse
gagggtctgaggggctgtgt

SEQ ID NO: 835534 - DNA, 20 bp, mouse
gcgagataaggcaaccatac

SEQ ID NO: 835535 - DNA, 20 bp, mouse
ggctgaaggcttcactgtca

SEQ ID NO: 835536 - DNA, 20 bp, mouse
gtggccacgcctcttgtcag

SEQ ID NO: 835537 - DNA, 20 bp, mouse
ggagaggcatgaactagagc

SEQ ID NO: 835538 - DNA, 20 bp, mouse
gaaagagcagtatactgtaa

SEQ ID NO: 835539 - DNA, 20 bp, mouse
gaatccgctgacaagaggcg

SEQ ID NO: 835540 - DNA, 20 bp, mouse
gcttcactgtcagagtctga

SEQ ID NO: 835541 - DNA, 20 bp, mouse
ggagctctatttcaagctgg

SEQ ID NO: 835542 - DNA, 20 bp, mouse
gcactgtcttagctcaacat

SEQ ID NO: 835543 - DNA, 20 bp, mouse
gagagtctgaggggctgtgt

SEQ ID NO: 835544 - DNA, 20 bp, mouse
gactgagcactgatggtggt

SEQ ID NO: 835545 - DNA, 20 bp, mouse
gtggacccgcccacgagatt

SEQ ID NO: 835546 - DNA, 20 bp, mouse
gaggggccccgtcacgtaga

SEQ ID NO: 835547 - DNA, 20 bp, mouse
gcccccgaggggagttgttc

SEQ ID NO: 835548 - DNA, 20 bp, mouse
gctgctgcggggctgcgtgg

SEQ ID NO: 835549 - DNA, 20 bp, mouse
gtgacggggcccctcgccgc

SEQ ID NO: 835550 - DNA, 20 bp, mouse
gggacatagcccctcagctt

SEQ ID NO: 835551 - DNA, 20 bp, mouse
ggggcccctcgccgctggtg

SEQ ID NO: 835552 - DNA, 20 bp, mouse
gctaccctagccatcccccg

SEQ ID NO: 835553 - DNA, 20 bp, mouse
gtcccctcgggggatggcta

SEQ ID NO: 835554 - DNA, 20 bp, mouse
gcccctcagcttcggaagag

SEQ ID NO: 835555 - DNA, 20 bp, mouse
gcatccagaacaactcccct

SEQ ID NO: 835556 - DNA, 20 bp, mouse
ggggacgcctaacgtatatg

SEQ ID NO: 835557 - DNA, 20 bp, mouse
gctaacagctcaattgagca

SEQ ID NO: 835558 - DNA, 20 bp, mouse
gtcaagaagtctgaaagctg

SEQ ID NO: 835559 - DNA, 20 bp, mouse
gtcgctggcaaggcagcatc

SEQ ID NO: 835560 - DNA, 20 bp, mouse
gaaaaaccaccccctgcttc

SEQ ID NO: 835561 - DNA, 20 bp, mouse
gtttctttggaccggaagca

SEQ ID NO: 835562 - DNA, 20 bp, mouse
ggcagcatctggactgcagc

SEQ ID NO: 835563 - DNA, 20 bp, mouse
gagtcagtctttctttggac

SEQ ID NO: 835564 - DNA, 20 bp, mouse
gaagttcttcaaaatctctc

SEQ ID NO: 835565 - DNA, 20 bp, mouse
gtgaactagaccaggactgt

SEQ ID NO: 835566 - DNA, 20 bp, mouse
ggaggtggggcaagaagagt

SEQ ID NO: 835567 - DNA, 20 bp, mouse
gcgctggggaacgtgaagag

SEQ ID NO: 835568 - DNA, 20 bp, mouse
gagtaggcggacaggcaaga

SEQ ID NO: 835569 - DNA, 20 bp, mouse
ggcacttcttagcttatcat

SEQ ID NO: 835570 - DNA, 20 bp, mouse
gagggggaagggtatatgta

SEQ ID NO: 835571 - DNA, 20 bp, mouse
gggtgtggctataagaacta

SEQ ID NO: 835572 - DNA, 20 bp, mouse
ggtggctataagaactatgg

SEQ ID NO: 835573 - DNA, 20 bp, mouse
ggcaagaagagtaggcggac

SEQ ID NO: 835574 - DNA, 20 bp, mouse
gtgcttcgtgtgcatatgtt

SEQ ID NO: 835575 - DNA, 20 bp, mouse
gatggtaagtataatgccca

SEQ ID NO: 835576 - DNA, 20 bp, mouse
gcccctgcgtgcgtgcgctg

SEQ ID NO: 835577 - DNA, 20 bp, mouse
gtgaagaggaaccgggaagc

SEQ ID NO: 835578 - DNA, 20 bp, mouse
gagccacagcgcacgcacgc

SEQ ID NO: 835579 - DNA, 20 bp, mouse
gatccgccccggatttgaag

SEQ ID NO: 835580 - DNA, 20 bp, mouse
gccctgcacggggaatgaat

SEQ ID NO: 835581 - DNA, 20 bp, mouse
gtggtggccccttctctctt

SEQ ID NO: 835582 - DNA, 20 bp, mouse
gttcctcttcaaatccgggg

SEQ ID NO: 835583 - DNA, 20 bp, mouse
ggtgaagcctaagagagaag

SEQ ID NO: 835584 - DNA, 20 bp, mouse
gtcacaggtggtaagagggt

SEQ ID NO: 835585 - DNA, 20 bp, mouse
gcccggttcctcttcaaatc

SEQ ID NO: 835586 - DNA, 20 bp, mouse
ggaagctctggggattttga

SEQ ID NO: 835587 - DNA, 20 bp, mouse
gcactcaatgccactctgaa

SEQ ID NO: 835588 - DNA, 20 bp, mouse
gccccagctgctctgtgagg

SEQ ID NO: 835589 - DNA, 20 bp, mouse
gcagctggggatttcccagg

SEQ ID NO: 835590 - DNA, 20 bp, mouse
gtccaagaaacccttcagag

SEQ ID NO: 835591 - DNA, 20 bp, mouse
gcgtccaggaaacgtcctaa

SEQ ID NO: 835592 - DNA, 20 bp, mouse
gtgcccattaggacgtttcc

SEQ ID NO: 835593 - DNA, 20 bp, mouse
gaaaagttttgcatggatga

SEQ ID NO: 835594 - DNA, 20 bp, mouse
gtatgcaagtgagaaggctc

SEQ ID NO: 835595 - DNA, 20 bp, mouse
ggagtggggactgaagctct

SEQ ID NO: 835596 - DNA, 20 bp, mouse
gaccgggaggggtctcagtg

SEQ ID NO: 835597 - DNA, 20 bp, mouse
ggggttagatctcagagcgc

SEQ ID NO: 835598 - DNA, 20 bp, mouse
gctaggagagctcgccctga

SEQ ID NO: 835599 - DNA, 20 bp, mouse
gtatctggggggagtttcaa

SEQ ID NO: 835600 - DNA, 20 bp, mouse
gaaggagctgcaggatctcc

SEQ ID NO: 835601 - DNA, 20 bp, mouse
ggaaggtcacagttagaagg

SEQ ID NO: 835602 - DNA, 20 bp, mouse
ggcacagaaaccctccagct

SEQ ID NO: 835603 - DNA, 20 bp, mouse
gaggacaaagggaccgggag

SEQ ID NO: 835604 - DNA, 20 bp, mouse
gacggtgattatgaggggac

SEQ ID NO: 835605 - DNA, 20 bp, mouse
gggcgagctctcctagctgg

SEQ ID NO: 835606 - DNA, 20 bp, mouse
gcacctcagagggccctgat

SEQ ID NO: 835607 - DNA, 20 bp, mouse
gaagaagagtgggagggcga

SEQ ID NO: 835608 - DNA, 20 bp, mouse
ggggtccagtggttggtttc

SEQ ID NO: 835609 - DNA, 20 bp, mouse
gtcagagggccctgatgggg

SEQ ID NO: 835610 - DNA, 20 bp, mouse
gcctgagagcgaagaagagt

SEQ ID NO: 835611 - DNA, 20 bp, mouse
ggaggtggaggctgtgggtt

SEQ ID NO: 835612 - DNA, 20 bp, mouse
gagagccagaaaccaaccac

SEQ ID NO: 835613 - DNA, 20 bp, mouse
ggagagtggtgtacaggaaa

SEQ ID NO: 835614 - DNA, 20 bp, mouse
ggtgggttgggtccagtggt

SEQ ID NO: 835615 - DNA, 20 bp, mouse
ggcagatgtgggagtgaaag

SEQ ID NO: 835616 - DNA, 20 bp, mouse
gcccccatcccgggacccga

SEQ ID NO: 835617 - DNA, 20 bp, mouse
gtgcaggcaggcgaccgcag

SEQ ID NO: 835618 - DNA, 20 bp, mouse
gcactggccctcagagttct

SEQ ID NO: 835619 - DNA, 20 bp, mouse
gtccagaccaagaactctga

SEQ ID NO: 835620 - DNA, 20 bp, mouse
ggggagggctcaacatactg

SEQ ID NO: 835621 - DNA, 20 bp, mouse
ggggagctggtgggcggatc

SEQ ID NO: 835622 - DNA, 20 bp, mouse
gagtgaaagcagaagtggac

SEQ ID NO: 835623 - DNA, 20 bp, mouse
ggggcggtgctgagttcctg

SEQ ID NO: 835624 - DNA, 20 bp, mouse
gcgggacccgagggatgggg

SEQ ID NO: 835625 - DNA, 20 bp, mouse
ggccggagggggggcggatg

SEQ ID NO: 835626 - DNA, 20 bp, mouse
gcggcccctaagttggagga

SEQ ID NO: 835627 - DNA, 20 bp, mouse
gtgtcactagctcgaccctg

SEQ ID NO: 835628 - DNA, 20 bp, mouse
gagggtgggaatacaggcaa

SEQ ID NO: 835629 - DNA, 20 bp, mouse
gggtgccaggagcagggaat

SEQ ID NO: 835630 - DNA, 20 bp, mouse
gccagcagggaggagaacca

SEQ ID NO: 835631 - DNA, 20 bp, mouse
gggaagagcgggttacgcaa

SEQ ID NO: 835632 - DNA, 20 bp, mouse
ggggcatggtgccaggagca

SEQ ID NO: 835633 - DNA, 20 bp, mouse
gatggcaccaaattctcctg

SEQ ID NO: 835634 - DNA, 20 bp, mouse
gggcaggtcggttggttatg

SEQ ID NO: 835635 - DNA, 20 bp, mouse
gaaggctggccgctccttct

SEQ ID NO: 835636 - DNA, 20 bp, mouse
gcccccagccgccgtgtcag

SEQ ID NO: 835637 - DNA, 20 bp, mouse
gggcttctaaggaaggggaa

SEQ ID NO: 835638 - DNA, 20 bp, mouse
gagatgcgaggcctctgaca

SEQ ID NO: 835639 - DNA, 20 bp, mouse
gttcttaagagcacactgaa

SEQ ID NO: 835640 - DNA, 20 bp, mouse
gaggcctctgacacggcggc

SEQ ID NO: 835641 - DNA, 20 bp, mouse
gtgcgaggcctctgacacgg

SEQ ID NO: 835642 - DNA, 20 bp, mouse
gtaaatgtggggtggattac

SEQ ID NO: 835643 - DNA, 20 bp, mouse
gcaccttcgataagcttgtc

SEQ ID NO: 835644 - DNA, 20 bp, mouse
gtaaggccacaccgggggtg

SEQ ID NO: 835645 - DNA, 20 bp, mouse
gactgaaagtgaaatgcgga

SEQ ID NO: 835646 - DNA, 20 bp, mouse
gtgactcaggtgggatggat

SEQ ID NO: 835647 - DNA, 20 bp, mouse
gccaccaagtacatcggagc

SEQ ID NO: 835648 - DNA, 20 bp, mouse
gtgcacgcgctgacaagcag

SEQ ID NO: 835649 - DNA, 20 bp, mouse
gagtgagagtgatcgaccgg

SEQ ID NO: 835650 - DNA, 20 bp, mouse
gccagaaaatgtgactcagg

SEQ ID NO: 835651 - DNA, 20 bp, mouse
gtgtcagcgcgtgcaaatgc

SEQ ID NO: 835652 - DNA, 20 bp, mouse
gttctggaaagtgtgagcta

SEQ ID NO: 835653 - DNA, 20 bp, mouse
gcccacagaagctcctctga

SEQ ID NO: 835654 - DNA, 20 bp, mouse
ggcccctgctccgatgtact

SEQ ID NO: 835655 - DNA, 20 bp, mouse
gtgtacagatgcacggttcg

SEQ ID NO: 835656 - DNA, 20 bp, mouse
gagcctgccctgcccggcta

SEQ ID NO: 835657 - DNA, 20 bp, mouse
gttccctagccgggcagggc

SEQ ID NO: 835658 - DNA, 20 bp, mouse
gggctgcagagggctgtcag

SEQ ID NO: 835659 - DNA, 20 bp, mouse
ggcgcattccctagccgggc

SEQ ID NO: 835660 - DNA, 20 bp, mouse
gctacaacagaaaccaagtt

SEQ ID NO: 835661 - DNA, 20 bp, mouse
gcgccctacgtcattctgga

SEQ ID NO: 835662 - DNA, 20 bp, mouse
gctcggctggctgcagtcca

SEQ ID NO: 835663 - DNA, 20 bp, mouse
gaggcggcgcattccctagc

SEQ ID NO: 835664 - DNA, 20 bp, mouse
gcacacttcccagaccagct

SEQ ID NO: 835665 - DNA, 20 bp, mouse
ggctggctgcagtccagggc

SEQ ID NO: 835666 - DNA, 20 bp, mouse
gccaacagaaacacgggagg

SEQ ID NO: 835667 - DNA, 20 bp, mouse
gactacaagggaagttcaga

SEQ ID NO: 835668 - DNA, 20 bp, mouse
gggggacagaagccactaca

SEQ ID NO: 835669 - DNA, 20 bp, mouse
gacgactgggtaagtcagag

SEQ ID NO: 835670 - DNA, 20 bp, mouse
gtgggtaagtcagagaggtg

SEQ ID NO: 835671 - DNA, 20 bp, mouse
gttagagccaacagaaacac

SEQ ID NO: 835672 - DNA, 20 bp, mouse
gcaccaggccaaacatacaa

SEQ ID NO: 835673 - DNA, 20 bp, mouse
ggccccgtgggtgtaggagg

SEQ ID NO: 835674 - DNA, 20 bp, mouse
gtccacctcctacacccacg

SEQ ID NO: 835675 - DNA, 20 bp, mouse
gtagcgtcttacagcagccg

SEQ ID NO: 835676 - DNA, 20 bp, mouse
gaactccctgttagcccgga

SEQ ID NO: 835677 - DNA, 20 bp, mouse
gtaacagggagttgtttttg

SEQ ID NO: 835678 - DNA, 20 bp, mouse
gaagtcactcaattcataac

SEQ ID NO: 835679 - DNA, 20 bp, mouse
gctgaagttttttattgcac

SEQ ID NO: 835680 - DNA, 20 bp, mouse
gaaacaactccctgttagcc

SEQ ID NO: 835681 - DNA, 20 bp, mouse
gtaattgcacaatagaagca

SEQ ID NO: 835682 - DNA, 20 bp, mouse
gatggtttaagacatcttga

SEQ ID NO: 835683 - DNA, 20 bp, mouse
ggatctttatctatcattac

SEQ ID NO: 835684 - DNA, 20 bp, mouse
gttaactctgcaggttttgc

SEQ ID NO: 835685 - DNA, 20 bp, mouse
gctgcaggttttgcaggcgg

SEQ ID NO: 835686 - DNA, 20 bp, mouse
gtcttgcagggtgctctcca

SEQ ID NO: 835687 - DNA, 20 bp, mouse
gaaagaagagcccactgttt

SEQ ID NO: 835688 - DNA, 20 bp, mouse
gagtctctttgctgggtccc

SEQ ID NO: 835689 - DNA, 20 bp, mouse
gtcagcagcacaatgactgt

SEQ ID NO: 835690 - DNA, 20 bp, mouse
gctaggggaagaaattagtg

SEQ ID NO: 835691 - DNA, 20 bp, mouse
gtaggtaaatgcccaaacag

SEQ ID NO: 835692 - DNA, 20 bp, mouse
gtagagcatgctgtaattgt

SEQ ID NO: 835693 - DNA, 20 bp, mouse
gccacagaacgccttgccgc

SEQ ID NO: 835694 - DNA, 20 bp, mouse
gtccagattagtctctttgc

SEQ ID NO: 835695 - DNA, 20 bp, mouse
gcacactgcatgatccatgc

SEQ ID NO: 835696 - DNA, 20 bp, mouse
gacagggcctggacagggaa

SEQ ID NO: 835697 - DNA, 20 bp, mouse
gagaaagttccgggagtcga

SEQ ID NO: 835698 - DNA, 20 bp, mouse
ggaaggggaaaggggcgaga

SEQ ID NO: 835699 - DNA, 20 bp, mouse
ggacgggcgggcacagggcc

SEQ ID NO: 835700 - DNA, 20 bp, mouse
gagaaggacgggcgggcaca

SEQ ID NO: 835701 - DNA, 20 bp, mouse
gagttccgggagtcgagggg

SEQ ID NO: 835702 - DNA, 20 bp, mouse
ggaggcgccttttccgggga

SEQ ID NO: 835703 - DNA, 20 bp, mouse
gtggggaacacagaaaaaga

SEQ ID NO: 835704 - DNA, 20 bp, mouse
gagggcagccgcggggttcc

SEQ ID NO: 835705 - DNA, 20 bp, mouse
gctaccgaggcgccttttcc

SEQ ID NO: 835706 - DNA, 20 bp, mouse
ggggacccggtcaggaagcg

SEQ ID NO: 835707 - DNA, 20 bp, mouse
gagcgcggcctctccccagt

SEQ ID NO: 835708 - DNA, 20 bp, mouse
gcctcccccaccctggctag

SEQ ID NO: 835709 - DNA, 20 bp, mouse
gtcaaaagctggggcggaaa

SEQ ID NO: 835710 - DNA, 20 bp, mouse
ggagaggcgtggtctccgac

SEQ ID NO: 835711 - DNA, 20 bp, mouse
ggtccctccgccactagcca

SEQ ID NO: 835712 - DNA, 20 bp, mouse
ggtggcggagggacccggtc

SEQ ID NO: 835713 - DNA, 20 bp, mouse
gcaccctggctagtggcgga

SEQ ID NO: 835714 - DNA, 20 bp, mouse
gtaaccctcaaaagctgggg

SEQ ID NO: 835715 - DNA, 20 bp, mouse
ggcacagagaggctcaaaaa

SEQ ID NO: 835716 - DNA, 20 bp, mouse
gccacccagaggagccactg

SEQ ID NO: 835717 - DNA, 20 bp, mouse
gaggtcctcaccttgcccgg

SEQ ID NO: 835718 - DNA, 20 bp, mouse
ggactgagggctcaaacgta

SEQ ID NO: 835719 - DNA, 20 bp, mouse
gtcaaacgtaggggtcctcc

SEQ ID NO: 835720 - DNA, 20 bp, mouse
ggcgaggtaaacagccgcag

SEQ ID NO: 835721 - DNA, 20 bp, mouse
gcctctgggtggagcgactg

SEQ ID NO: 835722 - DNA, 20 bp, mouse
ggggtcctccgggcaaggtg

SEQ ID NO: 835723 - DNA, 20 bp, mouse
ggcccagcgcgcaacgccat

SEQ ID NO: 835724 - DNA, 20 bp, mouse
gcaaggtgaggacctcccag

SEQ ID NO: 835725 - DNA, 20 bp, mouse
gggtctccggggactttccc

SEQ ID NO: 835726 - DNA, 20 bp, mouse
gaggcagcctggggagcaac

SEQ ID NO: 835727 - DNA, 20 bp, mouse
ggggagcaacaggtggaggc

SEQ ID NO: 835728 - DNA, 20 bp, mouse
ggctctgccagaggcgggat

SEQ ID NO: 835729 - DNA, 20 bp, mouse
gcagcctggggagcaacagg

SEQ ID NO: 835730 - DNA, 20 bp, mouse
gcatcccagcagggcagccc

SEQ ID NO: 835731 - DNA, 20 bp, mouse
ggcctcagctcggccttgtg

SEQ ID NO: 835732 - DNA, 20 bp, mouse
ggccccacaaggccgagctg

SEQ ID NO: 835733 - DNA, 20 bp, mouse
ggccttgtggggctgcctgg

SEQ ID NO: 835734 - DNA, 20 bp, mouse
gggaatctaccacaagtgac

SEQ ID NO: 835735 - DNA, 20 bp, mouse
gtccccaaggccacgcacac

SEQ ID NO: 835736 - DNA, 20 bp, mouse
ggcggggcggagtcagactc

SEQ ID NO: 835737 - DNA, 20 bp, mouse
gactccgccccgcctacagc

SEQ ID NO: 835738 - DNA, 20 bp, mouse
gagactccgggccatggacg

SEQ ID NO: 835739 - DNA, 20 bp, mouse
ggagccagctgtaggcgggg

SEQ ID NO: 835740 - DNA, 20 bp, mouse
ggagtcagactcccggcagt

SEQ ID NO: 835741 - DNA, 20 bp, mouse
ggacgaggcggagccagctg

SEQ ID NO: 835742 - DNA, 20 bp, mouse
gccaaaccctggtcgcagat

SEQ ID NO: 835743 - DNA, 20 bp, mouse
gggagtcagactccgggcca

SEQ ID NO: 835744 - DNA, 20 bp, mouse
gggcgggaaacgttccggga

SEQ ID NO: 835745 - DNA, 20 bp, mouse
gcagaccccatctgcgacca

SEQ ID NO: 835746 - DNA, 20 bp, mouse
gtctacccacagaatgcctg

SEQ ID NO: 835747 - DNA, 20 bp, mouse
gttagccccaggcattctgt

SEQ ID NO: 835748 - DNA, 20 bp, mouse
gaacagtgacctaactactt

SEQ ID NO: 835749 - DNA, 20 bp, mouse
ggtaggagaaactgctctaa

SEQ ID NO: 835750 - DNA, 20 bp, mouse
gaaactgctctaaaggaaga

SEQ ID NO: 835751 - DNA, 20 bp, mouse
gcaggcagtgactaagatgt

SEQ ID NO: 835752 - DNA, 20 bp, mouse
ggaaaagctaggttagcccc

SEQ ID NO: 835753 - DNA, 20 bp, mouse
ggctggaaagtcacacccgt

SEQ ID NO: 835754 - DNA, 20 bp, mouse
gttcccaggatgtctcaagt

SEQ ID NO: 835755 - DNA, 20 bp, mouse
gagaaacttcctcctctagt

SEQ ID NO: 835756 - DNA, 20 bp, mouse
gcgggaccccaggctgtgga

SEQ ID NO: 835757 - DNA, 20 bp, mouse
ggccgggaggaagagatcta

SEQ ID NO: 835758 - DNA, 20 bp, mouse
ggaccccaggctgtggaggg

SEQ ID NO: 835759 - DNA, 20 bp, mouse
ggaaaggcaaggcaagcgga

SEQ ID NO: 835760 - DNA, 20 bp, mouse
gaagaacagcatatgggaca

SEQ ID NO: 835761 - DNA, 20 bp, mouse
gcacctgtcctacaagtggg

SEQ ID NO: 835762 - DNA, 20 bp, mouse
gccctggtgacactttgtgg

SEQ ID NO: 835763 - DNA, 20 bp, mouse
gctaaaaagggcgggacccc

SEQ ID NO: 835764 - DNA, 20 bp, mouse
ggcggaaggaaggttaacca

SEQ ID NO: 835765 - DNA, 20 bp, mouse
gctcctcccacttgtaggac

SEQ ID NO: 835766 - DNA, 20 bp, mouse
gtatccctggctgtgagaca

SEQ ID NO: 835767 - DNA, 20 bp, mouse
gcgcgcctgcgccgccctag

SEQ ID NO: 835768 - DNA, 20 bp, mouse
gaaaccctgtctcacagcca

SEQ ID NO: 835769 - DNA, 20 bp, mouse
ggtcgctccgccttcttaaa

SEQ ID NO: 835770 - DNA, 20 bp, mouse
gcgcgcgggctctgagaacc

SEQ ID NO: 835771 - DNA, 20 bp, mouse
gcgggccccaccccctaggg

SEQ ID NO: 835772 - DNA, 20 bp, mouse
gcgggctctgagaacccggc

SEQ ID NO: 835773 - DNA, 20 bp, mouse
gggaccagggccctttaaga

SEQ ID NO: 835774 - DNA, 20 bp, mouse
gcagcgggccccacccccta

SEQ ID NO: 835775 - DNA, 20 bp, mouse
gccaccccctagggcggcgc

SEQ ID NO: 835776 - DNA, 20 bp, mouse
gcagactgacgggtacccga

SEQ ID NO: 835777 - DNA, 20 bp, mouse
gtgggggcgtggcttagtag

SEQ ID NO: 835778 - DNA, 20 bp, mouse
ggtggagtccgagagaagaa

SEQ ID NO: 835779 - DNA, 20 bp, mouse
gtggcttagtagtggagcga

SEQ ID NO: 835780 - DNA, 20 bp, mouse
gcagagaacaaccagcctgg

SEQ ID NO: 835781 - DNA, 20 bp, mouse
gggactccacccacttcggc

SEQ ID NO: 835782 - DNA, 20 bp, mouse
gacgccctggcgggctggct

SEQ ID NO: 835783 - DNA, 20 bp, mouse
gacagtacaaagagacagta

SEQ ID NO: 835784 - DNA, 20 bp, mouse
gaatcgggatccaacatacc

SEQ ID NO: 835785 - DNA, 20 bp, mouse
gcgttgccgcagtgacagta

SEQ ID NO: 835786 - DNA, 20 bp, mouse
gagagcgcgggcagcacgaa

SEQ ID NO: 835787 - DNA, 20 bp, mouse
ggaccggcccctcatttaca

SEQ ID NO: 835788 - DNA, 20 bp, mouse
ggcacgaagggaactgttgg

SEQ ID NO: 835789 - DNA, 20 bp, mouse
ggcagcacgaagggaactgt

SEQ ID NO: 835790 - DNA, 20 bp, mouse
gcatataggaaaccgggagt

SEQ ID NO: 835791 - DNA, 20 bp, mouse
ggaccttgtaaatgaggggc

SEQ ID NO: 835792 - DNA, 20 bp, mouse
gcgagccagtgcaagccccg

SEQ ID NO: 835793 - DNA, 20 bp, mouse
gatggtgctgtaatcagtgt

SEQ ID NO: 835794 - DNA, 20 bp, mouse
gcctctctaggcagtcatct

SEQ ID NO: 835795 - DNA, 20 bp, mouse
gacgaagctgaaacagagtc

SEQ ID NO: 835796 - DNA, 20 bp, mouse
ggccgcgcggaggggtttgt

SEQ ID NO: 835797 - DNA, 20 bp, mouse
ggctctgtaaagatggcggt

SEQ ID NO: 835798 - DNA, 20 bp, mouse
gcggccccgcttgcccaaac

SEQ ID NO: 835799 - DNA, 20 bp, mouse
ggggtgagaaatctcccagg

SEQ ID NO: 835800 - DNA, 20 bp, mouse
gagcagatgcggagagttaa

SEQ ID NO: 835801 - DNA, 20 bp, mouse
ggcaagcggggccgcgcgga

SEQ ID NO: 835802 - DNA, 20 bp, mouse
gctctccggccgggccagtt

SEQ ID NO: 835803 - DNA, 20 bp, mouse
gacttcccaagattcgtctt

SEQ ID NO: 835804 - DNA, 20 bp, mouse
gaactcgtctcgagaagtgt

SEQ ID NO: 835805 - DNA, 20 bp, mouse
ggacctctcgtttttagcag

SEQ ID NO: 835806 - DNA, 20 bp, mouse
gcacagaattccatccagaa

SEQ ID NO: 835807 - DNA, 20 bp, mouse
ggagccccctgggctccctc

SEQ ID NO: 835808 - DNA, 20 bp, mouse
gcgtagcacgggagccccct

SEQ ID NO: 835809 - DNA, 20 bp, mouse
gttggaaggggatcaagcct

SEQ ID NO: 835810 - DNA, 20 bp, mouse
ggcaaacagagcagaaaaaa

SEQ ID NO: 835811 - DNA, 20 bp, mouse
gatgtcataccagagccgga

SEQ ID NO: 835812 - DNA, 20 bp, mouse
gaatgaaaactattgtcttg

SEQ ID NO: 835813 - DNA, 20 bp, mouse
gtcttgggggttgggttgga

SEQ ID NO: 835814 - DNA, 20 bp, mouse
gaaaagggggacgacgacaa

SEQ ID NO: 835815 - DNA, 20 bp, mouse
gaaactattgtcttgggggt

SEQ ID NO: 835816 - DNA, 20 bp, mouse
ggagaggcaaggctctgaat

SEQ ID NO: 835817 - DNA, 20 bp, mouse
gaaaacgtttgcatgtctcc

SEQ ID NO: 835818 - DNA, 20 bp, mouse
gcagagggagaagatattga

SEQ ID NO: 835819 - DNA, 20 bp, mouse
gcagaggaggagccaatcaa

SEQ ID NO: 835820 - DNA, 20 bp, mouse
gctgtgtaatcaacgtaaga

SEQ ID NO: 835821 - DNA, 20 bp, mouse
gcagcagctaaaaataccac

SEQ ID NO: 835822 - DNA, 20 bp, mouse
gtcaaagcagggattccctt

SEQ ID NO: 835823 - DNA, 20 bp, mouse
gacaggggaactctaaccag

SEQ ID NO: 835824 - DNA, 20 bp, mouse
gaggcacctggcgaggtgta

SEQ ID NO: 835825 - DNA, 20 bp, mouse
gtaaatcaaggctatgacag

SEQ ID NO: 835826 - DNA, 20 bp, mouse
ggccctaggcagatgataca

SEQ ID NO: 835827 - DNA, 20 bp, mouse
gcctgagattacagggacca

SEQ ID NO: 835828 - DNA, 20 bp, mouse
gatgaaggactgcaaggacc

SEQ ID NO: 835829 - DNA, 20 bp, mouse
gttggccagcctgagattac

SEQ ID NO: 835830 - DNA, 20 bp, mouse
gtgcctgaggtcaagctgac

SEQ ID NO: 835831 - DNA, 20 bp, mouse
gctccggtcagcttgacctc

SEQ ID NO: 835832 - DNA, 20 bp, mouse
gctctgctacctaggttccc

SEQ ID NO: 835833 - DNA, 20 bp, mouse
gttttcttgagacttccctg

SEQ ID NO: 835834 - DNA, 20 bp, mouse
ggagattacagggaccaggg

SEQ ID NO: 835835 - DNA, 20 bp, mouse
gtgcagtccttcatagctcc

SEQ ID NO: 835836 - DNA, 20 bp, mouse
gaaggagggcacagcagaat

SEQ ID NO: 835837 - DNA, 20 bp, mouse
ggccctcctcctaagaatcc

SEQ ID NO: 835838 - DNA, 20 bp, mouse
gaggagctcccctaagacag

SEQ ID NO: 835839 - DNA, 20 bp, mouse
gtgagccacgggaatgtggg

SEQ ID NO: 835840 - DNA, 20 bp, mouse
gtgcagggaaatttaagctt

SEQ ID NO: 835841 - DNA, 20 bp, mouse
ggccctgctccactgtctta

SEQ ID NO: 835842 - DNA, 20 bp, mouse
ggatgcccctacaaatcctg

SEQ ID NO: 835843 - DNA, 20 bp, mouse
ggcactctctggcgttctcc

SEQ ID NO: 835844 - DNA, 20 bp, mouse
gtgggctaggactctaggag

SEQ ID NO: 835845 - DNA, 20 bp, mouse
gctaggactctaggagggga

SEQ ID NO: 835846 - DNA, 20 bp, mouse
gccaccctgcacacctcgca

SEQ ID NO: 835847 - DNA, 20 bp, mouse
ggtgctgccgtgtagaccac

SEQ ID NO: 835848 - DNA, 20 bp, mouse
ggggaagactacactggctg

SEQ ID NO: 835849 - DNA, 20 bp, mouse
gcgaggtgtgcagggtggga

SEQ ID NO: 835850 - DNA, 20 bp, mouse
gctgccctgcgaggtgtgca

SEQ ID NO: 835851 - DNA, 20 bp, mouse
gagagaggggaagactacac

SEQ ID NO: 835852 - DNA, 20 bp, mouse
gacactggtctctaagcctg

SEQ ID NO: 835853 - DNA, 20 bp, mouse
gtctaagcctgtggtctaca

SEQ ID NO: 835854 - DNA, 20 bp, mouse
gagaccagtgtgtgtgcatc

SEQ ID NO: 835855 - DNA, 20 bp, mouse
ggtcaaaggctcatgtgtgc

SEQ ID NO: 835856 - DNA, 20 bp, mouse
gccgggcccctgctcagaaa

SEQ ID NO: 835857 - DNA, 20 bp, mouse
gcaggccggcagcagtgagt

SEQ ID NO: 835858 - DNA, 20 bp, mouse
gccgcctggccggtcagccc

SEQ ID NO: 835859 - DNA, 20 bp, mouse
gggccggtcagcccaggcgc

SEQ ID NO: 835860 - DNA, 20 bp, mouse
gagtctcctcagaccaatgg

SEQ ID NO: 835861 - DNA, 20 bp, mouse
ggagctgcagctgtccccga

SEQ ID NO: 835862 - DNA, 20 bp, mouse
gtggggctggccagcacagg

SEQ ID NO: 835863 - DNA, 20 bp, mouse
gtggcctgtccaagaagtct

SEQ ID NO: 835864 - DNA, 20 bp, mouse
gggagactagagcactactc

SEQ ID NO: 835865 - DNA, 20 bp, mouse
gcagcccaactcactgctgc

SEQ ID NO: 835866 - DNA, 20 bp, mouse
ggaggaggggtgtagatcct

SEQ ID NO: 835867 - DNA, 20 bp, mouse
ggctggggcgctagagtcaa

SEQ ID NO: 835868 - DNA, 20 bp, mouse
gggggcgctagagtcaaagg

SEQ ID NO: 835869 - DNA, 20 bp, mouse
ggcgctagagtcaaaggagg

SEQ ID NO: 835870 - DNA, 20 bp, mouse
gagcgataacagggtgtgag

SEQ ID NO: 835871 - DNA, 20 bp, mouse
gggtcctggaagggtgtccc

SEQ ID NO: 835872 - DNA, 20 bp, mouse
ggaaaccgacagaaacgtgg

SEQ ID NO: 835873 - DNA, 20 bp, mouse
ggcccaggataagcgataac

SEQ ID NO: 835874 - DNA, 20 bp, mouse
ggctccagttgggtcaacca

SEQ ID NO: 835875 - DNA, 20 bp, mouse
gtcaccagggacacccttcc

SEQ ID NO: 835876 - DNA, 20 bp, mouse
ggcaaggacgtcagagagca

SEQ ID NO: 835877 - DNA, 20 bp, mouse
gtggctggagtctctttcag

SEQ ID NO: 835878 - DNA, 20 bp, mouse
ggagctgatcgtgtagtggc

SEQ ID NO: 835879 - DNA, 20 bp, mouse
gaggtgagctgatcgtgtag

SEQ ID NO: 835880 - DNA, 20 bp, mouse
gagtgaacatggaaagtgac

SEQ ID NO: 835881 - DNA, 20 bp, mouse
gcctacccagagggcatgtg

SEQ ID NO: 835882 - DNA, 20 bp, mouse
ggaggaactggcctacccag

SEQ ID NO: 835883 - DNA, 20 bp, mouse
gtttaagggagctgtgtgaa

SEQ ID NO: 835884 - DNA, 20 bp, mouse
gacgatcagctcacctttga

SEQ ID NO: 835885 - DNA, 20 bp, mouse
gtgtgtatctgcagggacta

SEQ ID NO: 835886 - DNA, 20 bp, mouse
gggggtccaacacctgtcat

SEQ ID NO: 835887 - DNA, 20 bp, mouse
gtactctaagagggtttgag

SEQ ID NO: 835888 - DNA, 20 bp, mouse
gccccgccccaggttggagg

SEQ ID NO: 835889 - DNA, 20 bp, mouse
gagcaaacaccgtagggctc

SEQ ID NO: 835890 - DNA, 20 bp, mouse
gggatgttgaagccgatgac

SEQ ID NO: 835891 - DNA, 20 bp, mouse
gtctaagagggtttgagggg

SEQ ID NO: 835892 - DNA, 20 bp, mouse
gcagggcagggctctgagca

SEQ ID NO: 835893 - DNA, 20 bp, mouse
gtgctgatggaaatcctaca

SEQ ID NO: 835894 - DNA, 20 bp, mouse
gaggtgttggacccccaaac

SEQ ID NO: 835895 - DNA, 20 bp, mouse
gtccatcagcaaacaccgta

SEQ ID NO: 835896 - DNA, 20 bp, mouse
gaggccgcagccccacaagc

SEQ ID NO: 835897 - DNA, 20 bp, mouse
gctactgccgcctgcttgtg

SEQ ID NO: 835898 - DNA, 20 bp, mouse
gtggcctccatggcctgggc

SEQ ID NO: 835899 - DNA, 20 bp, mouse
ggttctcatggacctgtccc

SEQ ID NO: 835900 - DNA, 20 bp, mouse
gcacaacaggggcataggac

SEQ ID NO: 835901 - DNA, 20 bp, mouse
gccaaaatagcactagaagt

SEQ ID NO: 835902 - DNA, 20 bp, mouse
gtccagggatcaggttctca

SEQ ID NO: 835903 - DNA, 20 bp, mouse
gatcagggctgtggtaggag

SEQ ID NO: 835904 - DNA, 20 bp, mouse
gtggaggaggaatgggatct

SEQ ID NO: 835905 - DNA, 20 bp, mouse
ggcaccagcccccttcctta

SEQ ID NO: 835906 - DNA, 20 bp, mouse
ggggggggaacaacacaatg

SEQ ID NO: 835907 - DNA, 20 bp, mouse
gaagctgggagcagagttga

SEQ ID NO: 835908 - DNA, 20 bp, mouse
gaatgtgcagcaggagatgg

SEQ ID NO: 835909 - DNA, 20 bp, mouse
gaggaccacatgagcttata

SEQ ID NO: 835910 - DNA, 20 bp, mouse
gtaagcaggcatgtgggctg

SEQ ID NO: 835911 - DNA, 20 bp, mouse
ggctctgcaggccttggtga

SEQ ID NO: 835912 - DNA, 20 bp, mouse
ggtgagccaagccccgcgga

SEQ ID NO: 835913 - DNA, 20 bp, mouse
gaggcccagaagagcaagct

SEQ ID NO: 835914 - DNA, 20 bp, mouse
gaaaaccagagcagatatgc

SEQ ID NO: 835915 - DNA, 20 bp, mouse
gtgttggctgctattttggc

SEQ ID NO: 835916 - DNA, 20 bp, mouse
gcccaaggaggcaaggatgg

SEQ ID NO: 835917 - DNA, 20 bp, mouse
gcaggcccctgaccaagtat

SEQ ID NO: 835918 - DNA, 20 bp, mouse
gggtggctggggcatgggaa

SEQ ID NO: 835919 - DNA, 20 bp, mouse
gcattcctatacttggtcag

SEQ ID NO: 835920 - DNA, 20 bp, mouse
gtataggaatgccccagagg

SEQ ID NO: 835921 - DNA, 20 bp, mouse
gaaggggctgtgtgtgacat

SEQ ID NO: 835922 - DNA, 20 bp, mouse
gcacccatctgctggccaat

SEQ ID NO: 835923 - DNA, 20 bp, mouse
gagcatgtgcccattgctga

SEQ ID NO: 835924 - DNA, 20 bp, mouse
ggaggagacatgcctggagg

SEQ ID NO: 835925 - DNA, 20 bp, mouse
gagatgggtggctggggcat

SEQ ID NO: 835926 - DNA, 20 bp, mouse
gtaccagcaaggtgtagcaa

SEQ ID NO: 835927 - DNA, 20 bp, mouse
ggaccaaacctgcattgaag

SEQ ID NO: 835928 - DNA, 20 bp, mouse
gcaggtttggtccccttttt

SEQ ID NO: 835929 - DNA, 20 bp, mouse
gtaaagaaggcttttcagac

SEQ ID NO: 835930 - DNA, 20 bp, mouse
ggtatcagaagtgtcaagac

SEQ ID NO: 835931 - DNA, 20 bp, mouse
gtgctggtacctaagtatta

SEQ ID NO: 835932 - DNA, 20 bp, mouse
gagccattgtgagcacaaag

SEQ ID NO: 835933 - DNA, 20 bp, mouse
gtgactttcaagttccctac

SEQ ID NO: 835934 - DNA, 20 bp, mouse
gcccctttttaggttaaaga

SEQ ID NO: 835935 - DNA, 20 bp, mouse
gggctgcttccttaatactt

SEQ ID NO: 835936 - DNA, 20 bp, mouse
gcagggcggggcagctttta

SEQ ID NO: 835937 - DNA, 20 bp, mouse
ggcagcttttagggtcctgt

SEQ ID NO: 835938 - DNA, 20 bp, mouse
ggggccgattatgatggcat

SEQ ID NO: 835939 - DNA, 20 bp, mouse
gcggcccagctatataacta

SEQ ID NO: 835940 - DNA, 20 bp, mouse
ggaactctgcagctgtcttg

SEQ ID NO: 835941 - DNA, 20 bp, mouse
gacaatctgacctgacccac

SEQ ID NO: 835942 - DNA, 20 bp, mouse
gtaggtggccgggtggaaaa

SEQ ID NO: 835943 - DNA, 20 bp, mouse
gccagcagctgggaagttaa

SEQ ID NO: 835944 - DNA, 20 bp, mouse
gggaagtatagccagtgtgt

SEQ ID NO: 835945 - DNA, 20 bp, mouse
gagggtacaattacttagtt

SEQ ID NO: 835946 - DNA, 20 bp, mouse
gttcgaccggggctttgcag

SEQ ID NO: 835947 - DNA, 20 bp, mouse
gccccggtcgaaatctgatt

SEQ ID NO: 835948 - DNA, 20 bp, mouse
gcccctgggtcctagtgcca

SEQ ID NO: 835949 - DNA, 20 bp, mouse
ggctcccgtgagcggatctt

SEQ ID NO: 835950 - DNA, 20 bp, mouse
gactacgacgactttcggaa

SEQ ID NO: 835951 - DNA, 20 bp, mouse
gagccaggctgcttacacga

SEQ ID NO: 835952 - DNA, 20 bp, mouse
gcaacccaactcttgcagcc

SEQ ID NO: 835953 - DNA, 20 bp, mouse
ggcaagcccctgcaaagccc

SEQ ID NO: 835954 - DNA, 20 bp, mouse
gtggccccaagatccgctca

SEQ ID NO: 835955 - DNA, 20 bp, mouse
gacgacgactttcggaatgg

SEQ ID NO: 835956 - DNA, 20 bp, mouse
gagacgctgggaggacctaa

SEQ ID NO: 835957 - DNA, 20 bp, mouse
gggcaagagaggcctagagg

SEQ ID NO: 835958 - DNA, 20 bp, mouse
ggaagcactcacacgtgatc

SEQ ID NO: 835959 - DNA, 20 bp, mouse
ggaggacctaatggcaagag

SEQ ID NO: 835960 - DNA, 20 bp, mouse
ggaaaaggaaacgagacgct

SEQ ID NO: 835961 - DNA, 20 bp, mouse
gtcaccaccaccagcttcac

SEQ ID NO: 835962 - DNA, 20 bp, mouse
gtctctcacgtgactcaact

SEQ ID NO: 835963 - DNA, 20 bp, mouse
gacgtgactcaacttggcca

SEQ ID NO: 835964 - DNA, 20 bp, mouse
ggggccagttaagagtactg

SEQ ID NO: 835965 - DNA, 20 bp, mouse
gcacgtgatctggcacagag

SEQ ID NO: 835966 - DNA, 20 bp, mouse
gctcccggaagtgaccctgc

SEQ ID NO: 835967 - DNA, 20 bp, mouse
gccggactaggagaaccaag

SEQ ID NO: 835968 - DNA, 20 bp, mouse
ggaaacaagaggaggcgtgc

SEQ ID NO: 835969 - DNA, 20 bp, mouse
gagccgaagcagggcttccc

SEQ ID NO: 835970 - DNA, 20 bp, mouse
gcctctgcgagcaaggcggg

SEQ ID NO: 835971 - DNA, 20 bp, mouse
ggaaccgggaggaaagactt

SEQ ID NO: 835972 - DNA, 20 bp, mouse
gcacgcagcgagccgaagca

SEQ ID NO: 835973 - DNA, 20 bp, mouse
gtaggcctctgcgagcaagg

SEQ ID NO: 835974 - DNA, 20 bp, mouse
ggggtgaagaagtaggaacc

SEQ ID NO: 835975 - DNA, 20 bp, mouse
gtggagacgggtgaagaagt

SEQ ID NO: 835976 - DNA, 20 bp, mouse
gggacaggatccaataaagt

SEQ ID NO: 835977 - DNA, 20 bp, mouse
gcgtgctgaaggcattaagg

SEQ ID NO: 835978 - DNA, 20 bp, mouse
gtaaaggggactcccttttg

SEQ ID NO: 835979 - DNA, 20 bp, mouse
ggtggaaggtgttggatggc

SEQ ID NO: 835980 - DNA, 20 bp, mouse
gcaggatccaataaagtagg

SEQ ID NO: 835981 - DNA, 20 bp, mouse
gaaggcattaagggggtaaa

SEQ ID NO: 835982 - DNA, 20 bp, mouse
gaccttgaggacagtccaga

SEQ ID NO: 835983 - DNA, 20 bp, mouse
gaccttctggactgtcctca

SEQ ID NO: 835984 - DNA, 20 bp, mouse
ggacaaagattctgaccttg

SEQ ID NO: 835985 - DNA, 20 bp, mouse
ggatccaataaagtaggagg

SEQ ID NO: 835986 - DNA, 20 bp, mouse
gggggctggcccgaaggggg

SEQ ID NO: 835987 - DNA, 20 bp, mouse
gggtgcccgccccccccttc

SEQ ID NO: 835988 - DNA, 20 bp, mouse
ggggggcttaagggggacgg

SEQ ID NO: 835989 - DNA, 20 bp, mouse
gccgggggctggcccgaagg

SEQ ID NO: 835990 - DNA, 20 bp, mouse
ggaccaatgcgctgcggccg

SEQ ID NO: 835991 - DNA, 20 bp, mouse
gaagaaacacgcattgttcc

SEQ ID NO: 835992 - DNA, 20 bp, mouse
gcgggggaggggagcctcgc

SEQ ID NO: 835993 - DNA, 20 bp, mouse
ggagccccgaggtccgtaat

SEQ ID NO: 835994 - DNA, 20 bp, mouse
gggtccgtaattggttttat

SEQ ID NO: 835995 - DNA, 20 bp, mouse
gcacgcgcatgtaaacacct

SEQ ID NO: 835996 - DNA, 20 bp, mouse
gtggcccgggagccccaaga

SEQ ID NO: 835997 - DNA, 20 bp, mouse
gaggccccagagccgctcgt

SEQ ID NO: 835998 - DNA, 20 bp, mouse
ggagctgtcggggaactccg

SEQ ID NO: 835999 - DNA, 20 bp, mouse
gcaactaggcctgccggacg

SEQ ID NO: 836000 - DNA, 20 bp, mouse
gagccgctcgtggggaacct

SEQ ID NO: 836001 - DNA, 20 bp, mouse
ggccgccgcaggccccagac

SEQ ID NO: 836002 - DNA, 20 bp, mouse
gtcgcagtaaagaaggagga

SEQ ID NO: 836003 - DNA, 20 bp, mouse
gggccacggcgcccccggaa

SEQ ID NO: 836004 - DNA, 20 bp, mouse
gttccccacgagcggctctg

SEQ ID NO: 836005 - DNA, 20 bp, mouse
gcgagtggggcattcacttc

SEQ ID NO: 836006 - DNA, 20 bp, mouse
gtgcctgcggccaatggagt

SEQ ID NO: 836007 - DNA, 20 bp, mouse
gcggcctgcgccaatcatga

SEQ ID NO: 836008 - DNA, 20 bp, mouse
gcaatgaggggagacggcag

SEQ ID NO: 836009 - DNA, 20 bp, mouse
ggaagcacttagccaatgag

SEQ ID NO: 836010 - DNA, 20 bp, mouse
gagcggcgaggacttaaggg

SEQ ID NO: 836011 - DNA, 20 bp, mouse
gcttaagggaggaggaccag

SEQ ID NO: 836012 - DNA, 20 bp, mouse
gaggaggaccagcggcttga

SEQ ID NO: 836013 - DNA, 20 bp, mouse
gcggacccagagagacgaag

SEQ ID NO: 836014 - DNA, 20 bp, mouse
gggcgaggacttaagggagg

SEQ ID NO: 836015 - DNA, 20 bp, mouse
ggggtgtgtcccctcatgat

SEQ ID NO: 836016 - DNA, 20 bp, mouse
gcccccgcgcgctccacgcg

SEQ ID NO: 836017 - DNA, 20 bp, mouse
gatacggcggggcgcagaac

SEQ ID NO: 836018 - DNA, 20 bp, mouse
gacagcgcgggcgggtatta

SEQ ID NO: 836019 - DNA, 20 bp, mouse
gaccgcatctgcataccgga

SEQ ID NO: 836020 - DNA, 20 bp, mouse
gcgtgacgaaccaatgggat

SEQ ID NO: 836021 - DNA, 20 bp, mouse
gtcccaccgcatctgcatac

SEQ ID NO: 836022 - DNA, 20 bp, mouse
ggaaagcaggcctccccagg

SEQ ID NO: 836023 - DNA, 20 bp, mouse
ggcgctggccctctgcgcag

SEQ ID NO: 836024 - DNA, 20 bp, mouse
gtgcaccgtagggaggtaca

SEQ ID NO: 836025 - DNA, 20 bp, mouse
gcagaaccggagaacggagg

SEQ ID NO: 836026 - DNA, 20 bp, mouse
gtctgaagggacagagacgg

SEQ ID NO: 836027 - DNA, 20 bp, mouse
gccactgcctggcagagcgg

SEQ ID NO: 836028 - DNA, 20 bp, mouse
gggagcgccggggttagatc

SEQ ID NO: 836029 - DNA, 20 bp, mouse
gaccagagaagggatctgaa

SEQ ID NO: 836030 - DNA, 20 bp, mouse
ggacagagacggtggcatgg

SEQ ID NO: 836031 - DNA, 20 bp, mouse
gacggtggcatggaggacga

SEQ ID NO: 836032 - DNA, 20 bp, mouse
gtctgcgacgtggggaagaa

SEQ ID NO: 836033 - DNA, 20 bp, mouse
ggggcggcggcgggatcccc

SEQ ID NO: 836034 - DNA, 20 bp, mouse
gtggggccgagaggtcgctg

SEQ ID NO: 836035 - DNA, 20 bp, mouse
gccccgggacaggctgaact

SEQ ID NO: 836036 - DNA, 20 bp, mouse
gcccccgcactcaccccctc

SEQ ID NO: 836037 - DNA, 20 bp, mouse
ggcggctccggcaatcgcta

SEQ ID NO: 836038 - DNA, 20 bp, mouse
gcctcgggttcctgacccaa

SEQ ID NO: 836039 - DNA, 20 bp, mouse
gccgcgcaccggagccctgc

SEQ ID NO: 836040 - DNA, 20 bp, mouse
gttagggaggccagcgaagt

SEQ ID NO: 836041 - DNA, 20 bp, mouse
gggggcccccgaggtattta

SEQ ID NO: 836042 - DNA, 20 bp, mouse
ggcctccctaaatacctcgg

SEQ ID NO: 836043 - DNA, 20 bp, mouse
gattgccggagccgcctcga

SEQ ID NO: 836044 - DNA, 20 bp, mouse
ggcccccgaggtatttaggg

SEQ ID NO: 836045 - DNA, 20 bp, mouse
gccacgggataataagtcac

SEQ ID NO: 836046 - DNA, 20 bp, mouse
ggggatgcaagcaccggtta

SEQ ID NO: 836047 - DNA, 20 bp, mouse
gggtggggcaggaacaggct

SEQ ID NO: 836048 - DNA, 20 bp, mouse
ggccacgtgtagggccatag

SEQ ID NO: 836049 - DNA, 20 bp, mouse
ggggtgggggatgcaagcac

SEQ ID NO: 836050 - DNA, 20 bp, mouse
gagcagttaggacacctctg

SEQ ID NO: 836051 - DNA, 20 bp, mouse
gtgtcctaactgctcaggtg

SEQ ID NO: 836052 - DNA, 20 bp, mouse
gagggccaagttaggagctt

SEQ ID NO: 836053 - DNA, 20 bp, mouse
gagaaggcgggctattttta

SEQ ID NO: 836054 - DNA, 20 bp, mouse
ggggccataggggagaagcg

SEQ ID NO: 836055 - DNA, 20 bp, mouse
ggagaagcggggcgggcaga

SEQ ID NO: 836056 - DNA, 20 bp, mouse
gggtgagaggaacacggtga

SEQ ID NO: 836057 - DNA, 20 bp, mouse
gtgcagagcaaacagaagat

SEQ ID NO: 836058 - DNA, 20 bp, mouse
gcgggcctctgtgattggga

SEQ ID NO: 836059 - DNA, 20 bp, mouse
ggctgaagaagggcctctct

SEQ ID NO: 836060 - DNA, 20 bp, mouse
ggcaaagcacagaggcctta

SEQ ID NO: 836061 - DNA, 20 bp, mouse
ggctctgcccgacatgagga

SEQ ID NO: 836062 - DNA, 20 bp, mouse
gctgatgtgtgctggagatg

SEQ ID NO: 836063 - DNA, 20 bp, mouse
gggagcatagtatcggtgag

SEQ ID NO: 836064 - DNA, 20 bp, mouse
gagaggcccttcttcagctt

SEQ ID NO: 836065 - DNA, 20 bp, mouse
gtgggtttggagcatagtat

SEQ ID NO: 836066 - DNA, 20 bp, mouse
ggggacttggccaatggcgt

SEQ ID NO: 836067 - DNA, 20 bp, mouse
gcggccggggggtgccgggt

SEQ ID NO: 836068 - DNA, 20 bp, mouse
gaggcgtgaccatctatcag

SEQ ID NO: 836069 - DNA, 20 bp, mouse
gttaagggaggccttggaag

SEQ ID NO: 836070 - DNA, 20 bp, mouse
gggtcacagcggcgttcagg

SEQ ID NO: 836071 - DNA, 20 bp, mouse
gttggaaggggattggacaa

SEQ ID NO: 836072 - DNA, 20 bp, mouse
gtcagcggccgtctggacgt

SEQ ID NO: 836073 - DNA, 20 bp, mouse
gccagacggccgctgataga

SEQ ID NO: 836074 - DNA, 20 bp, mouse
gcggccgtctggacgtgggc

SEQ ID NO: 836075 - DNA, 20 bp, mouse
ggacgtgggcaggcgggact

SEQ ID NO: 836076 - DNA, 20 bp, mouse
ggcgctcagaaggattccga

SEQ ID NO: 836077 - DNA, 20 bp, mouse
gcccctcgcagcccagtcgt

SEQ ID NO: 836078 - DNA, 20 bp, mouse
gagggtgagcagccccgctg

SEQ ID NO: 836079 - DNA, 20 bp, mouse
gcggagggacgcatcacgca

SEQ ID NO: 836080 - DNA, 20 bp, mouse
gcggcgctaaggcgctcaga

SEQ ID NO: 836081 - DNA, 20 bp, mouse
gggaatcccaacctacgact

SEQ ID NO: 836082 - DNA, 20 bp, mouse
ggacgcatcacgcaggggtg

SEQ ID NO: 836083 - DNA, 20 bp, mouse
ggttgggattccaggttctg

SEQ ID NO: 836084 - DNA, 20 bp, mouse
ggggttaaagatgccaaggg

SEQ ID NO: 836085 - DNA, 20 bp, mouse
gctgaggacgtggcagggag

SEQ ID NO: 836086 - DNA, 20 bp, mouse
gcgctcccaagaaaccccga

SEQ ID NO: 836087 - DNA, 20 bp, mouse
gtcccaagaaaccccgaagg

SEQ ID NO: 836088 - DNA, 20 bp, mouse
gtcggcgtctgggtcccgta

SEQ ID NO: 836089 - DNA, 20 bp, mouse
gctcctgcgcagtctccgac

SEQ ID NO: 836090 - DNA, 20 bp, mouse
gcgaagccacgcccccttcg

SEQ ID NO: 836091 - DNA, 20 bp, mouse
gcccgcccgaccactcggaa

SEQ ID NO: 836092 - DNA, 20 bp, mouse
ggcgcgcgctgagtgtctat

SEQ ID NO: 836093 - DNA, 20 bp, mouse
ggcccccttcggggtttctt

SEQ ID NO: 836094 - DNA, 20 bp, mouse
gggaacggaagttgacccta

SEQ ID NO: 836095 - DNA, 20 bp, mouse
ggggcgtggcttcggtcagt

SEQ ID NO: 836096 - DNA, 20 bp, mouse
gccgaagggagccactgcgc

SEQ ID NO: 836097 - DNA, 20 bp, mouse
gaggtcggaacacgcgtgcg

SEQ ID NO: 836098 - DNA, 20 bp, mouse
gcggcgacgcagcttgtggt

SEQ ID NO: 836099 - DNA, 20 bp, mouse
gcacgcgtgttccgacctca

SEQ ID NO: 836100 - DNA, 20 bp, mouse
gtgcgcggattagccggaag

SEQ ID NO: 836101 - DNA, 20 bp, mouse
gacgcagcttgtggtgggag

SEQ ID NO: 836102 - DNA, 20 bp, mouse
gcacgcgtgcgcggattagc

SEQ ID NO: 836103 - DNA, 20 bp, mouse
gccactgcgcaggcgtgtac

SEQ ID NO: 836104 - DNA, 20 bp, mouse
gtgcccgcaggagagtgttc

SEQ ID NO: 836105 - DNA, 20 bp, mouse
gcaggagagtgttcaggttt

SEQ ID NO: 836106 - DNA, 20 bp, mouse
ggcgcgcactgaagcttcag

SEQ ID NO: 836107 - DNA, 20 bp, mouse
gcatcctgaaactgggtctc

SEQ ID NO: 836108 - DNA, 20 bp, mouse
gggcccaggggcagcctagt

SEQ ID NO: 836109 - DNA, 20 bp, mouse
gtggccagagacccagtttc

SEQ ID NO: 836110 - DNA, 20 bp, mouse
gtgcgcgccactgtggagcc

SEQ ID NO: 836111 - DNA, 20 bp, mouse
ggcttggtccccaggactaa

SEQ ID NO: 836112 - DNA, 20 bp, mouse
gtcctggggaccaagccctg

SEQ ID NO: 836113 - DNA, 20 bp, mouse
gacagcctccttgcccaagt

SEQ ID NO: 836114 - DNA, 20 bp, mouse
gggctgacgccacaccaggg

SEQ ID NO: 836115 - DNA, 20 bp, mouse
gccaggggcagcctagtagg

SEQ ID NO: 836116 - DNA, 20 bp, mouse
gaggcgccaggcagcgagca

SEQ ID NO: 836117 - DNA, 20 bp, mouse
ggagtcacatcactccaccc

SEQ ID NO: 836118 - DNA, 20 bp, mouse
ggcacctcgtgactctaggt

SEQ ID NO: 836119 - DNA, 20 bp, mouse
gcggcagccaagcgctggag

SEQ ID NO: 836120 - DNA, 20 bp, mouse
ggctgcctggcgcctctccg

SEQ ID NO: 836121 - DNA, 20 bp, mouse
gcaggtgcgccaagtccccc

SEQ ID NO: 836122 - DNA, 20 bp, mouse
gaagaccgctcccctctctt

SEQ ID NO: 836123 - DNA, 20 bp, mouse
ggggaagcgccaggagcacg

SEQ ID NO: 836124 - DNA, 20 bp, mouse
gagcgggtggagtcggaggg

SEQ ID NO: 836125 - DNA, 20 bp, mouse
gacggagcgggtggagtcgg

SEQ ID NO: 836126 - DNA, 20 bp, mouse
gccaccccgcggcgtccgat

SEQ ID NO: 836127 - DNA, 20 bp, mouse
gtaaccagcccacttccgat

SEQ ID NO: 836128 - DNA, 20 bp, mouse
gtgaagtcccacccaccccg

SEQ ID NO: 836129 - DNA, 20 bp, mouse
gagcttgcttcgtgcccaat

SEQ ID NO: 836130 - DNA, 20 bp, mouse
gggttgtgccgctaggctga

SEQ ID NO: 836131 - DNA, 20 bp, mouse
gagcctagcggcacaacccc

SEQ ID NO: 836132 - DNA, 20 bp, mouse
ggtgtcgtccaatcggaagt

SEQ ID NO: 836133 - DNA, 20 bp, mouse
ggtgcccaatcggacgccgc

SEQ ID NO: 836134 - DNA, 20 bp, mouse
gcggcctgacctcgccctct

SEQ ID NO: 836135 - DNA, 20 bp, mouse
ggcaaggggagacagtcctt

SEQ ID NO: 836136 - DNA, 20 bp, mouse
gcggctgagacgccaagctg

SEQ ID NO: 836137 - DNA, 20 bp, mouse
ggcggggcgtgcactgcaga

SEQ ID NO: 836138 - DNA, 20 bp, mouse
gcagatggacccagtctgcg

SEQ ID NO: 836139 - DNA, 20 bp, mouse
ggaaagacgaaggtgggagc

SEQ ID NO: 836140 - DNA, 20 bp, mouse
ggcccctgaccccctggtca

SEQ ID NO: 836141 - DNA, 20 bp, mouse
ggaccccgggggaaggtccg

SEQ ID NO: 836142 - DNA, 20 bp, mouse
gcaggggcagcacgtgtttg

SEQ ID NO: 836143 - DNA, 20 bp, mouse
gagcaaggacagtggattag

SEQ ID NO: 836144 - DNA, 20 bp, mouse
gcccgtgaccagggggtcag

SEQ ID NO: 836145 - DNA, 20 bp, mouse
gtgcgtcatcccgtgaccag

SEQ ID NO: 836146 - DNA, 20 bp, mouse
ggctaagttgagataacgtg

SEQ ID NO: 836147 - DNA, 20 bp, mouse
gtggggccaattgaagtgca

SEQ ID NO: 836148 - DNA, 20 bp, mouse
gaaccccgggtcccgaaccc

SEQ ID NO: 836149 - DNA, 20 bp, mouse
gccctctcctgagttatggt

SEQ ID NO: 836150 - DNA, 20 bp, mouse
gcagggcatgcagtgtcctt

SEQ ID NO: 836151 - DNA, 20 bp, mouse
gtgttctggggacctacagg

SEQ ID NO: 836152 - DNA, 20 bp, mouse
gggtcttgtcaggctggaga

SEQ ID NO: 836153 - DNA, 20 bp, mouse
gtctccacccaccataactc

SEQ ID NO: 836154 - DNA, 20 bp, mouse
gttatggtgggtggagaact

SEQ ID NO: 836155 - DNA, 20 bp, mouse
gttggattgtgagtgttctg

SEQ ID NO: 836156 - DNA, 20 bp, mouse
ggactgtaagagtatgttca

SEQ ID NO: 836157 - DNA, 20 bp, mouse
gggctgtaggacaccggaag

SEQ ID NO: 836158 - DNA, 20 bp, mouse
gctggctagagagaaagcgt

SEQ ID NO: 836159 - DNA, 20 bp, mouse
gaagaggctggcgacaccaa

SEQ ID NO: 836160 - DNA, 20 bp, mouse
gattctgtgccgttgggtct

SEQ ID NO: 836161 - DNA, 20 bp, mouse
gggccatggctgtaggacac

SEQ ID NO: 836162 - DNA, 20 bp, mouse
gctggcggggagcggggcga

SEQ ID NO: 836163 - DNA, 20 bp, mouse
gccggaagacgctctgtcca

SEQ ID NO: 836164 - DNA, 20 bp, mouse
gcggaagagagcaggcgaag

SEQ ID NO: 836165 - DNA, 20 bp, mouse
gtggacgccgcgagccgaga

SEQ ID NO: 836166 - DNA, 20 bp, mouse
gagcggccggacagagctaa

SEQ ID NO: 836167 - DNA, 20 bp, mouse
ggcggagctaagagggtcgg

SEQ ID NO: 836168 - DNA, 20 bp, mouse
ggagctaagagggtcggagg

SEQ ID NO: 836169 - DNA, 20 bp, mouse
gtagacggggcggagctaag

SEQ ID NO: 836170 - DNA, 20 bp, mouse
gctggccccgcccctggaca

SEQ ID NO: 836171 - DNA, 20 bp, mouse
gtggaccggccctgaggggc

SEQ ID NO: 836172 - DNA, 20 bp, mouse
gcagacgaggcggggctaga

SEQ ID NO: 836173 - DNA, 20 bp, mouse
gacagctgaatcaccgaagg

SEQ ID NO: 836174 - DNA, 20 bp, mouse
gcggccgctcttccttgtcc

SEQ ID NO: 836175 - DNA, 20 bp, mouse
ggcttcccaggtccaacgga

SEQ ID NO: 836176 - DNA, 20 bp, mouse
gggtcaggggacatcagtag

SEQ ID NO: 836177 - DNA, 20 bp, mouse
gggagtagggcttcaacaga

SEQ ID NO: 836178 - DNA, 20 bp, mouse
gttagcgcacggggtaggag

SEQ ID NO: 836179 - DNA, 20 bp, mouse
gcggactcggctctcactgg

SEQ ID NO: 836180 - DNA, 20 bp, mouse
gcgagccaataggaaggtag

SEQ ID NO: 836181 - DNA, 20 bp, mouse
ggcactgactgatttcgact

SEQ ID NO: 836182 - DNA, 20 bp, mouse
ggtcgcgaaccaatgaactt

SEQ ID NO: 836183 - DNA, 20 bp, mouse
gggcggtgggcggatctcgg

SEQ ID NO: 836184 - DNA, 20 bp, mouse
gcggagcccaggccgggaag

SEQ ID NO: 836185 - DNA, 20 bp, mouse
gctctcactggcggccgcgg

SEQ ID NO: 836186 - DNA, 20 bp, mouse
gtactagtgaccaataggag

SEQ ID NO: 836187 - DNA, 20 bp, mouse
ggagaaaacagaagagtggc

SEQ ID NO: 836188 - DNA, 20 bp, mouse
gggcttcagtccgagtgcag

SEQ ID NO: 836189 - DNA, 20 bp, mouse
gaggttgggcggtcttaaaa

SEQ ID NO: 836190 - DNA, 20 bp, mouse
gtcccactcgccactgcact

SEQ ID NO: 836191 - DNA, 20 bp, mouse
gtccgagtgcagtggcgagt

SEQ ID NO: 836192 - DNA, 20 bp, mouse
ggtggcgagtgggagtttgt

SEQ ID NO: 836193 - DNA, 20 bp, mouse
gcggctttcaggaaggtgga

SEQ ID NO: 836194 - DNA, 20 bp, mouse
gccaccacgccgggaaggca

SEQ ID NO: 836195 - DNA, 20 bp, mouse
gggacggcggggggcggtag

SEQ ID NO: 836196 - DNA, 20 bp, mouse
ggctcagagacttaaggcgg

SEQ ID NO: 836197 - DNA, 20 bp, mouse
gaaggctcagagacttaagg

SEQ ID NO: 836198 - DNA, 20 bp, mouse
gcacagtccagatccaccca

SEQ ID NO: 836199 - DNA, 20 bp, mouse
gtgaagcaaagagacctgaa

SEQ ID NO: 836200 - DNA, 20 bp, mouse
gacaacagcaacactatcca

SEQ ID NO: 836201 - DNA, 20 bp, mouse
gtgtgacgggaacctgtgag

SEQ ID NO: 836202 - DNA, 20 bp, mouse
gggtggcactctcccggcta

SEQ ID NO: 836203 - DNA, 20 bp, mouse
gcaaagagacctgaaggggg

SEQ ID NO: 836204 - DNA, 20 bp, mouse
gcccaaggctcagagactta

SEQ ID NO: 836205 - DNA, 20 bp, mouse
gtctgagccttgggtggatc

SEQ ID NO: 836206 - DNA, 20 bp, mouse
gagccaggacgcctgatcgg

SEQ ID NO: 836207 - DNA, 20 bp, mouse
gggaaccgacccccgtccct

SEQ ID NO: 836208 - DNA, 20 bp, mouse
gggccccgcctcccagggac

SEQ ID NO: 836209 - DNA, 20 bp, mouse
gcggggctccgcctccgatc

SEQ ID NO: 836210 - DNA, 20 bp, mouse
gcaggacgcctgatcggagg

SEQ ID NO: 836211 - DNA, 20 bp, mouse
gacctgaaagacactttctt

SEQ ID NO: 836212 - DNA, 20 bp, mouse
gtagagccaggacgcctgat

SEQ ID NO: 836213 - DNA, 20 bp, mouse
gagcccagcctctgcggata

SEQ ID NO: 836214 - DNA, 20 bp, mouse
gaccgacccccgtccctggg

SEQ ID NO: 836215 - DNA, 20 bp, mouse
gagctaacccctatccgcag

SEQ ID NO: 836216 - DNA, 20 bp, mouse
gcgggagcagtgaacccgca

SEQ ID NO: 836217 - DNA, 20 bp, mouse
gagaacgggtgcaaagtaga

SEQ ID NO: 836218 - DNA, 20 bp, mouse
gctaggttgctggaaggcga

SEQ ID NO: 836219 - DNA, 20 bp, mouse
gcaacctagctccgccttgc

SEQ ID NO: 836220 - DNA, 20 bp, mouse
ggcggagctaggttgctgga

SEQ ID NO: 836221 - DNA, 20 bp, mouse
gaaaacaacaaaaacgaggc

SEQ ID NO: 836222 - DNA, 20 bp, mouse
ggagcagtgaacccgcaagg

SEQ ID NO: 836223 - DNA, 20 bp, mouse
gggcagcaaagtcttaaaca

SEQ ID NO: 836224 - DNA, 20 bp, mouse
gaccgtgtccggatcccgga

SEQ ID NO: 836225 - DNA, 20 bp, mouse
ggatgcagtagcagctccat

SEQ ID NO: 836226 - DNA, 20 bp, mouse
gcggcgaggaggggcgtggg

SEQ ID NO: 836227 - DNA, 20 bp, mouse
gcaaccgcctgcaagaggaa

SEQ ID NO: 836228 - DNA, 20 bp, mouse
gcggttgcctagaatcgctc

SEQ ID NO: 836229 - DNA, 20 bp, mouse
gcaggggagaaccacttccg

SEQ ID NO: 836230 - DNA, 20 bp, mouse
gcgtgtgcagcaagtgtaga

SEQ ID NO: 836231 - DNA, 20 bp, mouse
gcgcccctatctactgtaca

SEQ ID NO: 836232 - DNA, 20 bp, mouse
ggcgccaggccttctgaccc

SEQ ID NO: 836233 - DNA, 20 bp, mouse
ggccacgggtccttctgtcc

SEQ ID NO: 836234 - DNA, 20 bp, mouse
ggcatgccgggctagaccgg

SEQ ID NO: 836235 - DNA, 20 bp, mouse
ggaaaagggccagaggtcac

SEQ ID NO: 836236 - DNA, 20 bp, mouse
ggttctgctaagtttctcaa

SEQ ID NO: 836237 - DNA, 20 bp, mouse
gagaaacttagcagaactct

SEQ ID NO: 836238 - DNA, 20 bp, mouse
ggggatcaggacatgcggca

SEQ ID NO: 836239 - DNA, 20 bp, mouse
gataggaggcagctgaagtt

SEQ ID NO: 836240 - DNA, 20 bp, mouse
gtacctgagacctgcagttc

SEQ ID NO: 836241 - DNA, 20 bp, mouse
gcgcatgtcctgatcccaag

SEQ ID NO: 836242 - DNA, 20 bp, mouse
gtctcaaaggcctgagaaat

SEQ ID NO: 836243 - DNA, 20 bp, mouse
gggtccagcctccatccttg

SEQ ID NO: 836244 - DNA, 20 bp, mouse
gaacatcaataattgaaatc

SEQ ID NO: 836245 - DNA, 20 bp, mouse
gagaattaataaatattact

SEQ ID NO: 836246 - DNA, 20 bp, mouse
gaggtggcagaaggtctgtt

SEQ ID NO: 836247 - DNA, 20 bp, mouse
gcccttcggtggcccaagtg

SEQ ID NO: 836248 - DNA, 20 bp, mouse
gggcgccatcaggtggcaga

SEQ ID NO: 836249 - DNA, 20 bp, mouse
gggcagaaggtctgttgggt

SEQ ID NO: 836250 - DNA, 20 bp, mouse
gactctgacagcagccttga

SEQ ID NO: 836251 - DNA, 20 bp, mouse
gggtctgttgggtaggatct

SEQ ID NO: 836252 - DNA, 20 bp, mouse
gcccaagtgcggtagactcc

SEQ ID NO: 836253 - DNA, 20 bp, mouse
gggagtgagaaaatgggcgt

SEQ ID NO: 836254 - DNA, 20 bp, mouse
gcttaaccccgccccttcgg

SEQ ID NO: 836255 - DNA, 20 bp, mouse
gggtgggccttgcgtgttat

SEQ ID NO: 836256 - DNA, 20 bp, mouse
gcgctcgtggaaagaggctg

SEQ ID NO: 836257 - DNA, 20 bp, mouse
gggaacttgcgaggcaaaac

SEQ ID NO: 836258 - DNA, 20 bp, mouse
gaagctggagacacggtccc

SEQ ID NO: 836259 - DNA, 20 bp, mouse
gtgaggggaaatgcgaactt

SEQ ID NO: 836260 - DNA, 20 bp, mouse
gcgtcagcgctcgtggaaag

SEQ ID NO: 836261 - DNA, 20 bp, mouse
ggtggccgcccgggtgtcca

SEQ ID NO: 836262 - DNA, 20 bp, mouse
gggtgtccaaggtccagagg

SEQ ID NO: 836263 - DNA, 20 bp, mouse
gagtccgtatgctaataaag

SEQ ID NO: 836264 - DNA, 20 bp, mouse
gcaaaaccggctctgtctcc

SEQ ID NO: 836265 - DNA, 20 bp, mouse
gaagaggctgagggttgcgg

SEQ ID NO: 836266 - DNA, 20 bp, mouse
gctgcccgcccaccttggga

SEQ ID NO: 836267 - DNA, 20 bp, mouse
gagtagacacacttggtcag

SEQ ID NO: 836268 - DNA, 20 bp, mouse
ggaggggcaatgctcggccc

SEQ ID NO: 836269 - DNA, 20 bp, mouse
ggggcggagctctgtcagaa

SEQ ID NO: 836270 - DNA, 20 bp, mouse
gtacctgccatggcaacctg

SEQ ID NO: 836271 - DNA, 20 bp, mouse
ggggactcctggacgtgtgg

SEQ ID NO: 836272 - DNA, 20 bp, mouse
gtgcaactgcgtcctcctgg

SEQ ID NO: 836273 - DNA, 20 bp, mouse
gggggacgccttcccaaggt

SEQ ID NO: 836274 - DNA, 20 bp, mouse
gactcctggacgtgtggggg

SEQ ID NO: 836275 - DNA, 20 bp, mouse
gtgcgtcctcctggaggtgt

SEQ ID NO: 836276 - DNA, 20 bp, mouse
ggaccaatagcaattgttgg

SEQ ID NO: 836277 - DNA, 20 bp, mouse
gaaaatctgaccaatgagga

SEQ ID NO: 836278 - DNA, 20 bp, mouse
gaaaccaattaggtaaaaga

SEQ ID NO: 836279 - DNA, 20 bp, mouse
gcaattaggtaaaagaaggc

SEQ ID NO: 836280 - DNA, 20 bp, mouse
gtaccaccaacaattgctat

SEQ ID NO: 836281 - DNA, 20 bp, mouse
gtctagcccgcccaaatcag

SEQ ID NO: 836282 - DNA, 20 bp, mouse
ggcacatggaccttcctcat

SEQ ID NO: 836283 - DNA, 20 bp, mouse
gatcaccgactcgctctcat

SEQ ID NO: 836284 - DNA, 20 bp, mouse
gtgtgggtcgtgactcttgg

SEQ ID NO: 836285 - DNA, 20 bp, mouse
gagagccaatgagagcgagt

SEQ ID NO: 836286 - DNA, 20 bp, mouse
gtaaagggaggccaccacgg

SEQ ID NO: 836287 - DNA, 20 bp, mouse
ggggagggtgcggtggtcac

SEQ ID NO: 836288 - DNA, 20 bp, mouse
gagagcgaggcgagtgaatg

SEQ ID NO: 836289 - DNA, 20 bp, mouse
gcgaggggaaaacgtcattg

SEQ ID NO: 836290 - DNA, 20 bp, mouse
gattgcgggtagcaactgag

SEQ ID NO: 836291 - DNA, 20 bp, mouse
ggggcctgaaattttgggat

SEQ ID NO: 836292 - DNA, 20 bp, mouse
ggctgtcaagagtcattccg

SEQ ID NO: 836293 - DNA, 20 bp, mouse
gagtcctgggacaagggctg

SEQ ID NO: 836294 - DNA, 20 bp, mouse
gtaggggggcgggacccgag

SEQ ID NO: 836295 - DNA, 20 bp, mouse
ggccgggagtcctgggacaa

SEQ ID NO: 836296 - DNA, 20 bp, mouse
gggaggaggagaaacggtgt

SEQ ID NO: 836297 - DNA, 20 bp, mouse
gtcacgcgacgctgatgctg

SEQ ID NO: 836298 - DNA, 20 bp, mouse
gcctaggaccgtactgtccc

SEQ ID NO: 836299 - DNA, 20 bp, mouse
ggagtctccccacgacctaa

SEQ ID NO: 836300 - DNA, 20 bp, mouse
gggaacgtgcacagggcatg

SEQ ID NO: 836301 - DNA, 20 bp, mouse
gtagaatacagtggggtgga

SEQ ID NO: 836302 - DNA, 20 bp, mouse
gtgttggaggaacgtgcaca

SEQ ID NO: 836303 - DNA, 20 bp, mouse
ggttaacgggacttgtcctc

SEQ ID NO: 836304 - DNA, 20 bp, mouse
gtgtcccagggaagctaccg

SEQ ID NO: 836305 - DNA, 20 bp, mouse
ggagtcatgtgataccaaga

SEQ ID NO: 836306 - DNA, 20 bp, mouse
gcgggtgagcagtgggatgc

SEQ ID NO: 836307 - DNA, 20 bp, mouse
gcggcacggcgggtgagcag

SEQ ID NO: 836308 - DNA, 20 bp, mouse
gagcccctgctgctcccaac

SEQ ID NO: 836309 - DNA, 20 bp, mouse
gaaggtgtctgcaagttccg

SEQ ID NO: 836310 - DNA, 20 bp, mouse
ggtgtctccaaaaaatcatc

SEQ ID NO: 836311 - DNA, 20 bp, mouse
gccctccgatgtcgacacta

SEQ ID NO: 836312 - DNA, 20 bp, mouse
ggacaccttagtgtcgacat

SEQ ID NO: 836313 - DNA, 20 bp, mouse
gttccgaggctggtgagttc

SEQ ID NO: 836314 - DNA, 20 bp, mouse
gccggaagtgagttcgtgag

SEQ ID NO: 836315 - DNA, 20 bp, mouse
ggccgctgcgcctctcgctc

SEQ ID NO: 836316 - DNA, 20 bp, mouse
gtgcagccagggctcttcga

SEQ ID NO: 836317 - DNA, 20 bp, mouse
gaacctgtgcggtgaggctc

SEQ ID NO: 836318 - DNA, 20 bp, mouse
ggctgcacccggaggtgaca

SEQ ID NO: 836319 - DNA, 20 bp, mouse
ggagaagggtgaggaaccca

SEQ ID NO: 836320 - DNA, 20 bp, mouse
gacctccagaagtccaggtc

SEQ ID NO: 836321 - DNA, 20 bp, mouse
gtaagcgacagtggactcgc

SEQ ID NO: 836322 - DNA, 20 bp, mouse
gggccagagcctcaccgcac

SEQ ID NO: 836323 - DNA, 20 bp, mouse
gacaggaagcggaagtcggt

SEQ ID NO: 836324 - DNA, 20 bp, mouse
ggagccctggctgcacccgg

SEQ ID NO: 836325 - DNA, 20 bp, mouse
gagtggactcgcaggagtgt

SEQ ID NO: 836326 - DNA, 20 bp, mouse
gaagcggagcggtcggaaga

SEQ ID NO: 836327 - DNA, 20 bp, mouse
gccagaccccagagcatctc

SEQ ID NO: 836328 - DNA, 20 bp, mouse
gacgtgcagaagtggggcga

SEQ ID NO: 836329 - DNA, 20 bp, mouse
gcggagcggtcggaagaggg

SEQ ID NO: 836330 - DNA, 20 bp, mouse
gtcggaagagggcggtcctt

SEQ ID NO: 836331 - DNA, 20 bp, mouse
gcggcgcagctcatcgttcg

SEQ ID NO: 836332 - DNA, 20 bp, mouse
gccggaggaagtggcgtcat

SEQ ID NO: 836333 - DNA, 20 bp, mouse
gcccgctctgggaagcggag

SEQ ID NO: 836334 - DNA, 20 bp, mouse
gtctgcacgttctggactta

SEQ ID NO: 836335 - DNA, 20 bp, mouse
ggggtttgcggcaacagttt

SEQ ID NO: 836336 - DNA, 20 bp, mouse
ggctcgggctacacagggaa

SEQ ID NO: 836337 - DNA, 20 bp, mouse
gcaagcagctacaggtggaa

SEQ ID NO: 836338 - DNA, 20 bp, mouse
gctgcaacccctgacgtcag

SEQ ID NO: 836339 - DNA, 20 bp, mouse
gcacctgtagctgcttgctc

SEQ ID NO: 836340 - DNA, 20 bp, mouse
ggctacacagggaaaggacc

SEQ ID NO: 836341 - DNA, 20 bp, mouse
gtgcttgctcgggctacaca

SEQ ID NO: 836342 - DNA, 20 bp, mouse
ggcggaaaagcgtgtcctcc

SEQ ID NO: 836343 - DNA, 20 bp, mouse
gctgggctgcactgtgttag

SEQ ID NO: 836344 - DNA, 20 bp, mouse
gcggctccgcctcttcctgg

SEQ ID NO: 836345 - DNA, 20 bp, mouse
gcgtgtcctccaggaagagg

SEQ ID NO: 836346 - DNA, 20 bp, mouse
ggggccgccctctttgtccg

SEQ ID NO: 836347 - DNA, 20 bp, mouse
gtgcctgccccggacaaaga

SEQ ID NO: 836348 - DNA, 20 bp, mouse
gggaaccggaaatacgagtc

SEQ ID NO: 836349 - DNA, 20 bp, mouse
gcggccccgccagcaggaac

SEQ ID NO: 836350 - DNA, 20 bp, mouse
ggcggtgcgcggggtacggt

SEQ ID NO: 836351 - DNA, 20 bp, mouse
gagatggtagccactagcgt

SEQ ID NO: 836352 - DNA, 20 bp, mouse
gggcagtctaccgacgctag

SEQ ID NO: 836353 - DNA, 20 bp, mouse
gctgttacttgatggggata

SEQ ID NO: 836354 - DNA, 20 bp, mouse
gcgagtctgggcggtgcgcg

SEQ ID NO: 836355 - DNA, 20 bp, mouse
gccgcccagactcgtatttc

SEQ ID NO: 836356 - DNA, 20 bp, mouse
ggggaactgcgcaacagctt

SEQ ID NO: 836357 - DNA, 20 bp, mouse
gagccctcaggacacaccat

SEQ ID NO: 836358 - DNA, 20 bp, mouse
ggccagttgcccaccaccgg

SEQ ID NO: 836359 - DNA, 20 bp, mouse
ggaccagcgcccccggtggt

SEQ ID NO: 836360 - DNA, 20 bp, mouse
gctggctgaaggcaccaaag

SEQ ID NO: 836361 - DNA, 20 bp, mouse
gggcccatggtgtgtcctga

SEQ ID NO: 836362 - DNA, 20 bp, mouse
gccagagcccccatccggga

SEQ ID NO: 836363 - DNA, 20 bp, mouse
gcaggaggtggtaggacaag

SEQ ID NO: 836364 - DNA, 20 bp, mouse
ggcccccggtggtgggcaac

SEQ ID NO: 836365 - DNA, 20 bp, mouse
gatggccagttgcccaccac

SEQ ID NO: 836366 - DNA, 20 bp, mouse
ggagctgcccgcctccgctc

SEQ ID NO: 836367 - DNA, 20 bp, mouse
gtagtcctggagcttcagtt

SEQ ID NO: 836368 - DNA, 20 bp, mouse
gcaagagggaaggacgcagt

SEQ ID NO: 836369 - DNA, 20 bp, mouse
gtgggtcctggtgatttctg

SEQ ID NO: 836370 - DNA, 20 bp, mouse
gtgcgaagtgacccgagcgg

SEQ ID NO: 836371 - DNA, 20 bp, mouse
ggcggggccggcctccacgg

SEQ ID NO: 836372 - DNA, 20 bp, mouse
gtggtgcgaagtgacccgag

SEQ ID NO: 836373 - DNA, 20 bp, mouse
gggtccgggtggactcaatc

SEQ ID NO: 836374 - DNA, 20 bp, mouse
gaggacgcagtgggccgcgc

SEQ ID NO: 836375 - DNA, 20 bp, mouse
gaagtgacccgagcggaggc

SEQ ID NO: 836376 - DNA, 20 bp, mouse
gccaccttgagaagtggtgc

SEQ ID NO: 836377 - DNA, 20 bp, mouse
gggtggaagtggctgtaaac

SEQ ID NO: 836378 - DNA, 20 bp, mouse
gcagcctgcaccacttctca

SEQ ID NO: 836379 - DNA, 20 bp, mouse
gaggccagcactaaggttct

SEQ ID NO: 836380 - DNA, 20 bp, mouse
gtggatgatggctctcacag

SEQ ID NO: 836381 - DNA, 20 bp, mouse
gagacagtaactgacgatag

SEQ ID NO: 836382 - DNA, 20 bp, mouse
gctcacagaggccagcacta

SEQ ID NO: 836383 - DNA, 20 bp, mouse
ggtggtgcaggctgtgtggc

SEQ ID NO: 836384 - DNA, 20 bp, mouse
gccacttctcaaggtggaag

SEQ ID NO: 836385 - DNA, 20 bp, mouse
gaccatctcgtcccttaaaa

SEQ ID NO: 836386 - DNA, 20 bp, mouse
ggtaccggaagttcagtccc

SEQ ID NO: 836387 - DNA, 20 bp, mouse
gaaagccgccttgttggaaa

SEQ ID NO: 836388 - DNA, 20 bp, mouse
gcacacaggagacggagaga

SEQ ID NO: 836389 - DNA, 20 bp, mouse
gtccccgcccctttccaaca

SEQ ID NO: 836390 - DNA, 20 bp, mouse
gaacaggacctctaaaagat

SEQ ID NO: 836391 - DNA, 20 bp, mouse
gcgtcacaaaacaggaatgt

SEQ ID NO: 836392 - DNA, 20 bp, mouse
gccgcccctttccaacaagg

SEQ ID NO: 836393 - DNA, 20 bp, mouse
gttcctgacactcacaacgt

SEQ ID NO: 836394 - DNA, 20 bp, mouse
gggaagtgacagcgccgtac

SEQ ID NO: 836395 - DNA, 20 bp, mouse
gctcggaggaaaagttctgg

SEQ ID NO: 836396 - DNA, 20 bp, mouse
gaaggggagccgggagttgt

SEQ ID NO: 836397 - DNA, 20 bp, mouse
gactgcaaataggcctcctg

SEQ ID NO: 836398 - DNA, 20 bp, mouse
ggaccatggcaacgcgggac

SEQ ID NO: 836399 - DNA, 20 bp, mouse
ggcgggactgggtggttcgc

SEQ ID NO: 836400 - DNA, 20 bp, mouse
gtcgcagcagtactgcaaat

SEQ ID NO: 836401 - DNA, 20 bp, mouse
ggttcgcgggctcccccagg

SEQ ID NO: 836402 - DNA, 20 bp, mouse
gttggggctctaaaacccac

SEQ ID NO: 836403 - DNA, 20 bp, mouse
gctgctgcgagacaacctgt

SEQ ID NO: 836404 - DNA, 20 bp, mouse
gacccgtgaccatggcaacg

SEQ ID NO: 836405 - DNA, 20 bp, mouse
ggcccattgcctacaactcc

SEQ ID NO: 836406 - DNA, 20 bp, mouse
ggaccgctccgccctcgcag

SEQ ID NO: 836407 - DNA, 20 bp, mouse
gagccggcgcggcccaggat

SEQ ID NO: 836408 - DNA, 20 bp, mouse
ggaaactcaaactggtgtcc

SEQ ID NO: 836409 - DNA, 20 bp, mouse
gtgtgggaggcgcagctgaa

SEQ ID NO: 836410 - DNA, 20 bp, mouse
gcgggatgcaggctattctg

SEQ ID NO: 836411 - DNA, 20 bp, mouse
ggtcccgggactcttggagg

SEQ ID NO: 836412 - DNA, 20 bp, mouse
gactgagcaacccatcctaa

SEQ ID NO: 836413 - DNA, 20 bp, mouse
ggaatagcctgcatcccgag

SEQ ID NO: 836414 - DNA, 20 bp, mouse
ggctggcagtggccatttcg

SEQ ID NO: 836415 - DNA, 20 bp, mouse
ggcatcccgaggggcagaca

SEQ ID NO: 836416 - DNA, 20 bp, mouse
ggacccagaacccctatcca

SEQ ID NO: 836417 - DNA, 20 bp, mouse
gcagaggcgatgtcagtaga

SEQ ID NO: 836418 - DNA, 20 bp, mouse
gtatgggaagagctgctgga

SEQ ID NO: 836419 - DNA, 20 bp, mouse
gaggagtccagggaacctat

SEQ ID NO: 836420 - DNA, 20 bp, mouse
gtgaacggaaccaccagtgg

SEQ ID NO: 836421 - DNA, 20 bp, mouse
gggtccccagggacaggaac

SEQ ID NO: 836422 - DNA, 20 bp, mouse
ggagggcagactgagctttc

SEQ ID NO: 836423 - DNA, 20 bp, mouse
gggtctggctggcccaactc

SEQ ID NO: 836424 - DNA, 20 bp, mouse
gatccagggcacagagaggg

SEQ ID NO: 836425 - DNA, 20 bp, mouse
gccctgacccagataaactg

SEQ ID NO: 836426 - DNA, 20 bp, mouse
gcggcccagagggtacagtt

SEQ ID NO: 836427 - DNA, 20 bp, mouse
gttgcaggggagatcaagat

SEQ ID NO: 836428 - DNA, 20 bp, mouse
gcgggtgcgcgccacggctt

SEQ ID NO: 836429 - DNA, 20 bp, mouse
gtgcctggtccgctcggccc

SEQ ID NO: 836430 - DNA, 20 bp, mouse
gcgccggggccgagcggacc

SEQ ID NO: 836431 - DNA, 20 bp, mouse
gcaggggagatcaagatcgg

SEQ ID NO: 836432 - DNA, 20 bp, mouse
gggcggcgggccgacagcgc

SEQ ID NO: 836433 - DNA, 20 bp, mouse
gtgcgcgccacggcttgggg

SEQ ID NO: 836434 - DNA, 20 bp, mouse
gacggaacagagaggcgtct

SEQ ID NO: 836435 - DNA, 20 bp, mouse
gcgtggggctcgcacagcaa

SEQ ID NO: 836436 - DNA, 20 bp, mouse
ggggccccccttgccctcgg

SEQ ID NO: 836437 - DNA, 20 bp, mouse
ggagccgccgagggcaaggg

SEQ ID NO: 836438 - DNA, 20 bp, mouse
gtggactggcaactaactct

SEQ ID NO: 836439 - DNA, 20 bp, mouse
gaactctaggggcggagggt

SEQ ID NO: 836440 - DNA, 20 bp, mouse
gcccgcaagcgctattgttc

SEQ ID NO: 836441 - DNA, 20 bp, mouse
gaggaacggtccacttggac

SEQ ID NO: 836442 - DNA, 20 bp, mouse
gcaactaactctaggggcgg

SEQ ID NO: 836443 - DNA, 20 bp, mouse
gacactgtccccaatatttg

SEQ ID NO: 836444 - DNA, 20 bp, mouse
gcggagaccaaggcgaccag

SEQ ID NO: 836445 - DNA, 20 bp, mouse
ggggacaggaacggtccact

SEQ ID NO: 836446 - DNA, 20 bp, mouse
gcgagcccggaggcggtcgg

SEQ ID NO: 836447 - DNA, 20 bp, mouse
ggggacaaagaggaccgggg

SEQ ID NO: 836448 - DNA, 20 bp, mouse
ggcccggaggcggtcggcgg

SEQ ID NO: 836449 - DNA, 20 bp, mouse
gcagctgcccgcggtgggag

SEQ ID NO: 836450 - DNA, 20 bp, mouse
gcccgcgccccgtgcagccc

SEQ ID NO: 836451 - DNA, 20 bp, mouse
gaagaggaccggggagggaa

SEQ ID NO: 836452 - DNA, 20 bp, mouse
gcgcgccagctgcccgcggt

SEQ ID NO: 836453 - DNA, 20 bp, mouse
gccaccgcgcgctcctctcc

SEQ ID NO: 836454 - DNA, 20 bp, mouse
ggggtgggacggtgagaggc

SEQ ID NO: 836455 - DNA, 20 bp, mouse
ggcggtggccggggctgcac

SEQ ID NO: 836456 - DNA, 20 bp, mouse
ggggcagctgggatcgagac

SEQ ID NO: 836457 - DNA, 20 bp, mouse
ggtaccggacgccgcctcta

SEQ ID NO: 836458 - DNA, 20 bp, mouse
ggagtggctagagaggtcgg

SEQ ID NO: 836459 - DNA, 20 bp, mouse
gctggagcttggtgggataa

SEQ ID NO: 836460 - DNA, 20 bp, mouse
gaagccgctggctcccagac

SEQ ID NO: 836461 - DNA, 20 bp, mouse
gagacagggaacagggtcta

SEQ ID NO: 836462 - DNA, 20 bp, mouse
gaggagacccgtagattgag

SEQ ID NO: 836463 - DNA, 20 bp, mouse
gcactgggtggccctagagg

SEQ ID NO: 836464 - DNA, 20 bp, mouse
gagggaacagggtctaaggc

SEQ ID NO: 836465 - DNA, 20 bp, mouse
gagacgcagcttgagctaga

SEQ ID NO: 836466 - DNA, 20 bp, mouse
ggcttcagggagggatacga

SEQ ID NO: 836467 - DNA, 20 bp, mouse
gtaggctgggcgactcccct

SEQ ID NO: 836468 - DNA, 20 bp, mouse
ggcccctggcccaacctcca

SEQ ID NO: 836469 - DNA, 20 bp, mouse
gcaccaaaggatgccgggga

SEQ ID NO: 836470 - DNA, 20 bp, mouse
gtacgaggggcaacctaggc

SEQ ID NO: 836471 - DNA, 20 bp, mouse
ggccccaggtaggggcttca

SEQ ID NO: 836472 - DNA, 20 bp, mouse
ggggatacgaggggcaacct

SEQ ID NO: 836473 - DNA, 20 bp, mouse
ggctgggcgactcccctagg

SEQ ID NO: 836474 - DNA, 20 bp, mouse
gtccctgaagcccctacctg

SEQ ID NO: 836475 - DNA, 20 bp, mouse
gacctctgctgccccaggta

SEQ ID NO: 836476 - DNA, 20 bp, mouse
gcctggagtcctatagccca

SEQ ID NO: 836477 - DNA, 20 bp, mouse
gttggggtactaatgagcca

SEQ ID NO: 836478 - DNA, 20 bp, mouse
gcaggcatttacgaaattga

SEQ ID NO: 836479 - DNA, 20 bp, mouse
gccccaatgctgtgctttgt

SEQ ID NO: 836480 - DNA, 20 bp, mouse
gagcccacaaagcacagcat

SEQ ID NO: 836481 - DNA, 20 bp, mouse
gaccattggccctgggctat

SEQ ID NO: 836482 - DNA, 20 bp, mouse
gttgatgacaccattggccc

SEQ ID NO: 836483 - DNA, 20 bp, mouse
gatatcagagaaggatcctg

SEQ ID NO: 836484 - DNA, 20 bp, mouse
ggggagctccaagtgggtcc

SEQ ID NO: 836485 - DNA, 20 bp, mouse
gagggaaggtgctagataaa

SEQ ID NO: 836486 - DNA, 20 bp, mouse
gacagtggggaagtatcatg

SEQ ID NO: 836487 - DNA, 20 bp, mouse
gcccacaaagcacaatatca

SEQ ID NO: 836488 - DNA, 20 bp, mouse
gccccaggctctaggactcc

SEQ ID NO: 836489 - DNA, 20 bp, mouse
gtgggctgccgaagaagaag

SEQ ID NO: 836490 - DNA, 20 bp, mouse
gcagggtactaaatgagcca

SEQ ID NO: 836491 - DNA, 20 bp, mouse
gcaggcattaatgaaattga

SEQ ID NO: 836492 - DNA, 20 bp, mouse
ggtgggtctcacatagagaa

SEQ ID NO: 836493 - DNA, 20 bp, mouse
gaggttggaaatgaatgttg

SEQ ID NO: 836494 - DNA, 20 bp, mouse
gaaatgaatgttgaggtcct

SEQ ID NO: 836495 - DNA, 20 bp, mouse
gctggataaactcagacagt

SEQ ID NO: 836496 - DNA, 20 bp, mouse
gccgccctccctttgggagg

SEQ ID NO: 836497 - DNA, 20 bp, mouse
gggttgcgcgagtgaggcgg

SEQ ID NO: 836498 - DNA, 20 bp, mouse
ggccccgccctccctttggg

SEQ ID NO: 836499 - DNA, 20 bp, mouse
gcggggaagccccaggctgc

SEQ ID NO: 836500 - DNA, 20 bp, mouse
gcattggcgaaacgtcagag

SEQ ID NO: 836501 - DNA, 20 bp, mouse
gcctcactcgcgcaaccaac

SEQ ID NO: 836502 - DNA, 20 bp, mouse
gcagccctcctcccaaaggg

SEQ ID NO: 836503 - DNA, 20 bp, mouse
gcctcgccccgccctccctt

SEQ ID NO: 836504 - DNA, 20 bp, mouse
gctggacgggatggcaagtg

SEQ ID NO: 836505 - DNA, 20 bp, mouse
gaagccccgcccacggccct

SEQ ID NO: 836506 - DNA, 20 bp, mouse
gaagcggagcgccacccatt

SEQ ID NO: 836507 - DNA, 20 bp, mouse
ggcgccacccattgggggag

SEQ ID NO: 836508 - DNA, 20 bp, mouse
gaacaagcccctcccccaat

SEQ ID NO: 836509 - DNA, 20 bp, mouse
gccgcgagagccaggcgttc

SEQ ID NO: 836510 - DNA, 20 bp, mouse
ggagccaggcgttccggagg

SEQ ID NO: 836511 - DNA, 20 bp, mouse
ggagaaatccctctggaagg

SEQ ID NO: 836512 - DNA, 20 bp, mouse
gaagcccctcccccaatggg

SEQ ID NO: 836513 - DNA, 20 bp, mouse
gcgagagccaggcgttccgg

SEQ ID NO: 836514 - DNA, 20 bp, mouse
gacggagaaatccctctgga

SEQ ID NO: 836515 - DNA, 20 bp, mouse
gaaagaagctaaggctatca

SEQ ID NO: 836516 - DNA, 20 bp, mouse
ggggcggcggcgctttgcac

SEQ ID NO: 836517 - DNA, 20 bp, mouse
ggcaaagacgggagtggggt

SEQ ID NO: 836518 - DNA, 20 bp, mouse
gtggcggagcgcacaggtcg

SEQ ID NO: 836519 - DNA, 20 bp, mouse
gtgaaagcaaagacgggagt

SEQ ID NO: 836520 - DNA, 20 bp, mouse
ggccgcccgagccgacgtgg

SEQ ID NO: 836521 - DNA, 20 bp, mouse
gccgacgtggcggagcgcac

SEQ ID NO: 836522 - DNA, 20 bp, mouse
gtgcacagggggcggagaaa

SEQ ID NO: 836523 - DNA, 20 bp, mouse
gaggctgcacaagcagctac

SEQ ID NO: 836524 - DNA, 20 bp, mouse
gggcagggaagaggaccccg

SEQ ID NO: 836525 - DNA, 20 bp, mouse
gatacccaaggagctgacgg

SEQ ID NO: 836526 - DNA, 20 bp, mouse
ggccgctctgcgcacccagt

SEQ ID NO: 836527 - DNA, 20 bp, mouse
gtcccactgggtgcgcagag

SEQ ID NO: 836528 - DNA, 20 bp, mouse
gggtcctggtggagacagtc

SEQ ID NO: 836529 - DNA, 20 bp, mouse
gcaaccgagaacgccaggtc

SEQ ID NO: 836530 - DNA, 20 bp, mouse
gtgtcgcgagcattcgtgga

SEQ ID NO: 836531 - DNA, 20 bp, mouse
ggcgcccgacctggcgttct

SEQ ID NO: 836532 - DNA, 20 bp, mouse
gggcttctgggctatggtgt

SEQ ID NO: 836533 - DNA, 20 bp, mouse
gttgcgctgtgtagcctagg

SEQ ID NO: 836534 - DNA, 20 bp, mouse
gcgcgtgtcgcgagcattcg

SEQ ID NO: 836535 - DNA, 20 bp, mouse
gcggcaggtggcgcccgacc

SEQ ID NO: 836536 - DNA, 20 bp, mouse
gctgaagctcgaggcatggg

SEQ ID NO: 836537 - DNA, 20 bp, mouse
gggcagccgaggttaaaggt

SEQ ID NO: 836538 - DNA, 20 bp, mouse
gcagctgaagctcgaggcat

SEQ ID NO: 836539 - DNA, 20 bp, mouse
gggtcagactgcagcgaagc

SEQ ID NO: 836540 - DNA, 20 bp, mouse
gttcaccgagggcgggaaga

SEQ ID NO: 836541 - DNA, 20 bp, mouse
gacgaacccgagcggaagga

SEQ ID NO: 836542 - DNA, 20 bp, mouse
gaggggactggggagtacat

SEQ ID NO: 836543 - DNA, 20 bp, mouse
gaccgagggcgggaagaagg

SEQ ID NO: 836544 - DNA, 20 bp, mouse
ggaggttaaaggtgggaagt

SEQ ID NO: 836545 - DNA, 20 bp, mouse
gggaagcaatgcttctagtc

SEQ ID NO: 836546 - DNA, 20 bp, mouse
gaaagctcaccaggaatcta

SEQ ID NO: 836547 - DNA, 20 bp, mouse
ggaaaacacgaagagcggta

SEQ ID NO: 836548 - DNA, 20 bp, mouse
gctcggaaggagactaagtg

SEQ ID NO: 836549 - DNA, 20 bp, mouse
gcctgggaaaacacgaagag

SEQ ID NO: 836550 - DNA, 20 bp, mouse
ggagagcccaggccgagtct

SEQ ID NO: 836551 - DNA, 20 bp, mouse
gcttagaaaaagtacttggg

SEQ ID NO: 836552 - DNA, 20 bp, mouse
gcggtatggatgccagacaa

SEQ ID NO: 836553 - DNA, 20 bp, mouse
gggtcgagcaacaggatact

SEQ ID NO: 836554 - DNA, 20 bp, mouse
gtaagtgaggccaaaaaccc

SEQ ID NO: 836555 - DNA, 20 bp, mouse
gcaaaaacccgggagagccc

SEQ ID NO: 836556 - DNA, 20 bp, mouse
gtgaagcgaagcccgggcca

SEQ ID NO: 836557 - DNA, 20 bp, mouse
ggccgcccatcctctcctgg

SEQ ID NO: 836558 - DNA, 20 bp, mouse
gaagcccgggccagggtcgc

SEQ ID NO: 836559 - DNA, 20 bp, mouse
gtccgccaggagaggatggg

SEQ ID NO: 836560 - DNA, 20 bp, mouse
gcgggccgcccatcctctcc

SEQ ID NO: 836561 - DNA, 20 bp, mouse
gagaggatgggcggcccggg

SEQ ID NO: 836562 - DNA, 20 bp, mouse
gggtccgcgccacgcttctc

SEQ ID NO: 836563 - DNA, 20 bp, mouse
gcgcctccggccccggcgag

SEQ ID NO: 836564 - DNA, 20 bp, mouse
ggggaccaagcctggcggcc

SEQ ID NO: 836565 - DNA, 20 bp, mouse
gtggcagcggcacttccgcc

SEQ ID NO: 836566 - DNA, 20 bp, mouse
gggaacagcgcgggtgtggg

SEQ ID NO: 836567 - DNA, 20 bp, mouse
gacagcagacagcgactaag

SEQ ID NO: 836568 - DNA, 20 bp, mouse
gggcgggaacagcgcgggtg

SEQ ID NO: 836569 - DNA, 20 bp, mouse
ggacacaatgacctcccgcg

SEQ ID NO: 836570 - DNA, 20 bp, mouse
ggacagcgactaagaggtca

SEQ ID NO: 836571 - DNA, 20 bp, mouse
gggcgccgggcgcacggttg

SEQ ID NO: 836572 - DNA, 20 bp, mouse
gtgctctgcaacccaggcgc

SEQ ID NO: 836573 - DNA, 20 bp, mouse
ggtgtcaatagcaggtgtga

SEQ ID NO: 836574 - DNA, 20 bp, mouse
ggagaagcgcatcgtcagaa

SEQ ID NO: 836575 - DNA, 20 bp, mouse
ggctgtctgctctgcaaccc

SEQ ID NO: 836576 - DNA, 20 bp, mouse
gctaactagcctggaaccaa

SEQ ID NO: 836577 - DNA, 20 bp, mouse
gcgtgcacgagtgcaagcca

SEQ ID NO: 836578 - DNA, 20 bp, mouse
gcagaggagctggtgttgga

SEQ ID NO: 836579 - DNA, 20 bp, mouse
ggtgtgctagcacattcctg

SEQ ID NO: 836580 - DNA, 20 bp, mouse
gcactatgacatttctcatg

SEQ ID NO: 836581 - DNA, 20 bp, mouse
gaccagtgagacagggatgc

SEQ ID NO: 836582 - DNA, 20 bp, mouse
gagactggccttgagtgacc

SEQ ID NO: 836583 - DNA, 20 bp, mouse
gcagcaatgctgtaccccag

SEQ ID NO: 836584 - DNA, 20 bp, mouse
ggacaagagtggtctttgtg

SEQ ID NO: 836585 - DNA, 20 bp, mouse
ggtgtggcattttcaatatt

SEQ ID NO: 836586 - DNA, 20 bp, mouse
gtggaggggaacaatacatc

SEQ ID NO: 836587 - DNA, 20 bp, mouse
ggtaggtcgagtagctcttt

SEQ ID NO: 836588 - DNA, 20 bp, mouse
ggaaacaaacaaatctcatc

SEQ ID NO: 836589 - DNA, 20 bp, mouse
gcagacgtgtaatctgactg

SEQ ID NO: 836590 - DNA, 20 bp, mouse
gctctttgggaagagatgga

SEQ ID NO: 836591 - DNA, 20 bp, mouse
gcatagttacttaaagacgg

SEQ ID NO: 836592 - DNA, 20 bp, mouse
gtgaatctcaagtctgctat

SEQ ID NO: 836593 - DNA, 20 bp, mouse
ggagattcaaaattagacga

SEQ ID NO: 836594 - DNA, 20 bp, mouse
gtgagatttgtttgtttcgt

SEQ ID NO: 836595 - DNA, 20 bp, mouse
ggattacacgtctgaagctt

SEQ ID NO: 836596 - DNA, 20 bp, mouse
gagaacgtcgaaacaccggg

SEQ ID NO: 836597 - DNA, 20 bp, mouse
gccgggctaaccatggcgga

SEQ ID NO: 836598 - DNA, 20 bp, mouse
gcaaggggccgggctaacca

SEQ ID NO: 836599 - DNA, 20 bp, mouse
ggaccaaggggcatttcctg

SEQ ID NO: 836600 - DNA, 20 bp, mouse
gctcaactgtcgagccactg

SEQ ID NO: 836601 - DNA, 20 bp, mouse
ggggaaggcggagcagcaag

SEQ ID NO: 836602 - DNA, 20 bp, mouse
gcaatgttctagagggttca

SEQ ID NO: 836603 - DNA, 20 bp, mouse
gaatggggcgctttcggagt

SEQ ID NO: 836604 - DNA, 20 bp, mouse
gctcaaacgtcctgcctcag

SEQ ID NO: 836605 - DNA, 20 bp, mouse
gggcgctttcggagttggaa

SEQ ID NO: 836606 - DNA, 20 bp, mouse
gcttcccgggatgggtatgt

SEQ ID NO: 836607 - DNA, 20 bp, mouse
gtaggtgggtagaagcggga

SEQ ID NO: 836608 - DNA, 20 bp, mouse
gccttcccaatgcctctgat

SEQ ID NO: 836609 - DNA, 20 bp, mouse
gtgggctctgtagtggacaa

SEQ ID NO: 836610 - DNA, 20 bp, mouse
gccaccgcgggagtttgtat

SEQ ID NO: 836611 - DNA, 20 bp, mouse
ggttaaaagagcagagggca

SEQ ID NO: 836612 - DNA, 20 bp, mouse
gggcccatgctgtgaaggat

SEQ ID NO: 836613 - DNA, 20 bp, mouse
gagcccaatacaaactcccg

SEQ ID NO: 836614 - DNA, 20 bp, mouse
gacagctgttaaaagagcag

SEQ ID NO: 836615 - DNA, 20 bp, mouse
gtttagaaaggggttacccc

SEQ ID NO: 836616 - DNA, 20 bp, mouse
ggggtgtaacagatgggcga

SEQ ID NO: 836617 - DNA, 20 bp, mouse
gcggcagccaggggcccctc

SEQ ID NO: 836618 - DNA, 20 bp, mouse
gaaagagaaggtggactcag

SEQ ID NO: 836619 - DNA, 20 bp, mouse
gggcccctccggaagaggcg

SEQ ID NO: 836620 - DNA, 20 bp, mouse
gtggactgggtgtaacagat

SEQ ID NO: 836621 - DNA, 20 bp, mouse
ggagccccgcctcttccgga

SEQ ID NO: 836622 - DNA, 20 bp, mouse
gaaggtggactcagtggact

SEQ ID NO: 836623 - DNA, 20 bp, mouse
gtggaattctccactgtgca

SEQ ID NO: 836624 - DNA, 20 bp, mouse
gttgctagaagctacgcagg

SEQ ID NO: 836625 - DNA, 20 bp, mouse
ggccgcgcgttcgcgggaga

SEQ ID NO: 836626 - DNA, 20 bp, mouse
gccggcaggcggcagcgaat

SEQ ID NO: 836627 - DNA, 20 bp, mouse
gcaactgggaggccggcagg

SEQ ID NO: 836628 - DNA, 20 bp, mouse
gctggagaggagcccggcac

SEQ ID NO: 836629 - DNA, 20 bp, mouse
gccaccgtcaactgggaggc

SEQ ID NO: 836630 - DNA, 20 bp, mouse
gagacgatggctctgagagg

SEQ ID NO: 836631 - DNA, 20 bp, mouse
gcggcagcgaatgggcgtgc

SEQ ID NO: 836632 - DNA, 20 bp, mouse
gctcccaggcccagagggga

SEQ ID NO: 836633 - DNA, 20 bp, mouse
gcgctctttcccaggcgtgc

SEQ ID NO: 836634 - DNA, 20 bp, mouse
ggaccttgaccgccagacga

SEQ ID NO: 836635 - DNA, 20 bp, mouse
gggacggcctcgcccggccg

SEQ ID NO: 836636 - DNA, 20 bp, mouse
gcgcacgcgcagtggttcca

SEQ ID NO: 836637 - DNA, 20 bp, mouse
gcgagcgcaggggacaggcg

SEQ ID NO: 836638 - DNA, 20 bp, mouse
gctacttggcccaggctcag

SEQ ID NO: 836639 - DNA, 20 bp, mouse
gagaagcaggccggaagtca

SEQ ID NO: 836640 - DNA, 20 bp, mouse
ggcccaggagccgtgacttc

SEQ ID NO: 836641 - DNA, 20 bp, mouse
gggccgcacagagagagccg

SEQ ID NO: 836642 - DNA, 20 bp, mouse
gggcgccggcgttacaaagc

SEQ ID NO: 836643 - DNA, 20 bp, mouse
gcgcaggggacaggcgcggc

SEQ ID NO: 836644 - DNA, 20 bp, mouse
gaaccactgcgcgtgcgcgc

SEQ ID NO: 836645 - DNA, 20 bp, mouse
ggcacagagagagccgcggg

SEQ ID NO: 836646 - DNA, 20 bp, mouse
gaggcggggctgggacccga

SEQ ID NO: 836647 - DNA, 20 bp, mouse
gagaccgcgtgccctcccct

SEQ ID NO: 836648 - DNA, 20 bp, mouse
gacccgaggggtgggcgcaa

SEQ ID NO: 836649 - DNA, 20 bp, mouse
ggggcccccggggctatttc

SEQ ID NO: 836650 - DNA, 20 bp, mouse
gctgctgctagccgagggga

SEQ ID NO: 836651 - DNA, 20 bp, mouse
gacccgagggggcggacccg

SEQ ID NO: 836652 - DNA, 20 bp, mouse
gccccggcccaagggtcttg

SEQ ID NO: 836653 - DNA, 20 bp, mouse
gccctcgggtccgccccctc

SEQ ID NO: 836654 - DNA, 20 bp, mouse
gtgcttccgacggctggctg

SEQ ID NO: 836655 - DNA, 20 bp, mouse
gaccaaggcccaaaccttgt

SEQ ID NO: 836656 - DNA, 20 bp, mouse
ggcagcccgcagaaagtgaa

SEQ ID NO: 836657 - DNA, 20 bp, mouse
gtaaccctaggcgaccactc

SEQ ID NO: 836658 - DNA, 20 bp, mouse
gggccctgagtggtcgccta

SEQ ID NO: 836659 - DNA, 20 bp, mouse
gttactggactaaggaaaga

SEQ ID NO: 836660 - DNA, 20 bp, mouse
gaagcgcctctcagttacta

SEQ ID NO: 836661 - DNA, 20 bp, mouse
gagcagacgcagtggtaggg

SEQ ID NO: 836662 - DNA, 20 bp, mouse
ggggagcagacgcagtggta

SEQ ID NO: 836663 - DNA, 20 bp, mouse
gaaggaaagacggccctgag

SEQ ID NO: 836664 - DNA, 20 bp, mouse
ggcccgcagaaagtgaaggg

SEQ ID NO: 836665 - DNA, 20 bp, mouse
ggaggcaccggataagagag

SEQ ID NO: 836666 - DNA, 20 bp, mouse
gccttggtctataaatgaaa

SEQ ID NO: 836667 - DNA, 20 bp, mouse
gatgtgtaggatgtgagttc

SEQ ID NO: 836668 - DNA, 20 bp, mouse
gttttgtttccaacaagaaa

SEQ ID NO: 836669 - DNA, 20 bp, mouse
gggggctggggaagaacgga

SEQ ID NO: 836670 - DNA, 20 bp, mouse
gggaaactctggcagggtgt

SEQ ID NO: 836671 - DNA, 20 bp, mouse
gtggtcagccaggcatggga

SEQ ID NO: 836672 - DNA, 20 bp, mouse
gtctctggtcagccaggcat

SEQ ID NO: 836673 - DNA, 20 bp, mouse
gatgagtggatgagtggata

SEQ ID NO: 836674 - DNA, 20 bp, mouse
gggggggggctggggaagaa

SEQ ID NO: 836675 - DNA, 20 bp, mouse
gcactcatccactcatccct

SEQ ID NO: 836676 - DNA, 20 bp, mouse
gccggcccgggtgacctcat

SEQ ID NO: 836677 - DNA, 20 bp, mouse
gcaggcggggcgggcagtga

SEQ ID NO: 836678 - DNA, 20 bp, mouse
gggagcccacagggcaaagg

SEQ ID NO: 836679 - DNA, 20 bp, mouse
gggaggacgaggagcccaca

SEQ ID NO: 836680 - DNA, 20 bp, mouse
ggcgacgtcagcaccgggcg

SEQ ID NO: 836681 - DNA, 20 bp, mouse
ggggagggggtggctgacgt

SEQ ID NO: 836682 - DNA, 20 bp, mouse
gccgctgggccaggcggggc

SEQ ID NO: 836683 - DNA, 20 bp, mouse
gccggccgcgacgtcagcac

SEQ ID NO: 836684 - DNA, 20 bp, mouse
gtaaagcagacggagaataa

SEQ ID NO: 836685 - DNA, 20 bp, mouse
gcgtggaggacgaactggac

SEQ ID NO: 836686 - DNA, 20 bp, mouse
ggggccctacgcgttctggg

SEQ ID NO: 836687 - DNA, 20 bp, mouse
gaactctgcccaggacacgc

SEQ ID NO: 836688 - DNA, 20 bp, mouse
gtctccgcccagaacgcgta

SEQ ID NO: 836689 - DNA, 20 bp, mouse
ggcggggccctacgcgttct

SEQ ID NO: 836690 - DNA, 20 bp, mouse
ggggtcacagggtcctggga

SEQ ID NO: 836691 - DNA, 20 bp, mouse
ggcgcagtggcggaaatcat

SEQ ID NO: 836692 - DNA, 20 bp, mouse
ggggcctgggcggcctgggt

SEQ ID NO: 836693 - DNA, 20 bp, mouse
gggtggggtcacagggtcct

SEQ ID NO: 836694 - DNA, 20 bp, mouse
gggcggagcctgcgtgtcct

SEQ ID NO: 836695 - DNA, 20 bp, mouse
gagttctcacgccccgggca

SEQ ID NO: 836696 - DNA, 20 bp, mouse
gccaagtgcttgtgtgtcct

SEQ ID NO: 836697 - DNA, 20 bp, mouse
gggaacctctctgtctttct

SEQ ID NO: 836698 - DNA, 20 bp, mouse
gaaaaaagtgccactcctag

SEQ ID NO: 836699 - DNA, 20 bp, mouse
gggcacctggactagatgga

SEQ ID NO: 836700 - DNA, 20 bp, mouse
gctgacctagaaagacagag

SEQ ID NO: 836701 - DNA, 20 bp, mouse
gtaggatgaacttgaaacgt

SEQ ID NO: 836702 - DNA, 20 bp, mouse
gaggaggcacctggactaga

SEQ ID NO: 836703 - DNA, 20 bp, mouse
gagagggagagaactggtgg

SEQ ID NO: 836704 - DNA, 20 bp, mouse
gagaatatagatcaagtatg

SEQ ID NO: 836705 - DNA, 20 bp, mouse
ggcacagagtccatttatac

SEQ ID NO: 836706 - DNA, 20 bp, mouse
gacttgggcagcaggtgaag

SEQ ID NO: 836707 - DNA, 20 bp, mouse
gtctgaagccccataggtat

SEQ ID NO: 836708 - DNA, 20 bp, mouse
gaggagcagcccatacctat

SEQ ID NO: 836709 - DNA, 20 bp, mouse
ggtgttgagcatctaagccc

SEQ ID NO: 836710 - DNA, 20 bp, mouse
gacgtcactagttactaggc

SEQ ID NO: 836711 - DNA, 20 bp, mouse
gacagacagacttgggcagc

SEQ ID NO: 836712 - DNA, 20 bp, mouse
gcattcagaacagctcattt

SEQ ID NO: 836713 - DNA, 20 bp, mouse
gtaaaggaatcataaaggag

SEQ ID NO: 836714 - DNA, 20 bp, mouse
gtctagggtcctaagcctga

SEQ ID NO: 836715 - DNA, 20 bp, mouse
gacagagtaggaagcagtct

SEQ ID NO: 836716 - DNA, 20 bp, mouse
gccgctacgagtcacgacga

SEQ ID NO: 836717 - DNA, 20 bp, mouse
ggctgcggatgacaacgcac

SEQ ID NO: 836718 - DNA, 20 bp, mouse
gctaccgcgggacggaggtg

SEQ ID NO: 836719 - DNA, 20 bp, mouse
gaacggagtgtgcgctgctg

SEQ ID NO: 836720 - DNA, 20 bp, mouse
gcgcgaggatcccacgcctc

SEQ ID NO: 836721 - DNA, 20 bp, mouse
gaccgcacacgattgggtac

SEQ ID NO: 836722 - DNA, 20 bp, mouse
gcgggttaagccaacctcgg

SEQ ID NO: 836723 - DNA, 20 bp, mouse
gcggatgacaacgcactgga

SEQ ID NO: 836724 - DNA, 20 bp, mouse
gggaacgggctgtctgcctg

SEQ ID NO: 836725 - DNA, 20 bp, mouse
gcccaatcgtgtgcggtcag

SEQ ID NO: 836726 - DNA, 20 bp, mouse
gacccagggtgcggtcgctg

SEQ ID NO: 836727 - DNA, 20 bp, mouse
gtgggtcgagcggcgtccat

SEQ ID NO: 836728 - DNA, 20 bp, mouse
gtcgagcggcgtccataggc

SEQ ID NO: 836729 - DNA, 20 bp, mouse
gcgcagcgcactgacacccg

SEQ ID NO: 836730 - DNA, 20 bp, mouse
ggctgtggagcgtgggaacc

SEQ ID NO: 836731 - DNA, 20 bp, mouse
gcgtgcggccagtcgcaagt

SEQ ID NO: 836732 - DNA, 20 bp, mouse
gtgcggtcgctgtggagctg

SEQ ID NO: 836733 - DNA, 20 bp, mouse
gcactaaggcccctcccagc

SEQ ID NO: 836734 - DNA, 20 bp, mouse
gtgcctgtggcagccttgta

SEQ ID NO: 836735 - DNA, 20 bp, mouse
gctgtggagctgtggagcgt

SEQ ID NO: 836736 - DNA, 20 bp, mouse
gtctgcttctgatgctgtaa

SEQ ID NO: 836737 - DNA, 20 bp, mouse
ggccacagggagacaaaaat

SEQ ID NO: 836738 - DNA, 20 bp, mouse
gctcccccaagaggagaaat

SEQ ID NO: 836739 - DNA, 20 bp, mouse
gccccaagaggagaaattgg

SEQ ID NO: 836740 - DNA, 20 bp, mouse
ggctggaccactcccccaag

SEQ ID NO: 836741 - DNA, 20 bp, mouse
gtcaagctgcgtaaagattg

SEQ ID NO: 836742 - DNA, 20 bp, mouse
gaggccagaagctgtaagat

SEQ ID NO: 836743 - DNA, 20 bp, mouse
gcgtaaagattgtggaatca

SEQ ID NO: 836744 - DNA, 20 bp, mouse
gagacaaaaatgggtgaaga

SEQ ID NO: 836745 - DNA, 20 bp, mouse
gtgttatatgacatcacttc

SEQ ID NO: 836746 - DNA, 20 bp, mouse
gaggaccgcggttgaagggg

SEQ ID NO: 836747 - DNA, 20 bp, mouse
gaccccctaggctgtctcgg

SEQ ID NO: 836748 - DNA, 20 bp, mouse
gacagtgagtcccaccccct

SEQ ID NO: 836749 - DNA, 20 bp, mouse
gctcccgccgagacagccta

SEQ ID NO: 836750 - DNA, 20 bp, mouse
ggcccacagagcacataggg

SEQ ID NO: 836751 - DNA, 20 bp, mouse
gcccgccctatgtgctctgt

SEQ ID NO: 836752 - DNA, 20 bp, mouse
gtcccgcccgggagccggca

SEQ ID NO: 836753 - DNA, 20 bp, mouse
gtagggcggggtctggtggg

SEQ ID NO: 836754 - DNA, 20 bp, mouse
gagcgcccacagagcacata

SEQ ID NO: 836755 - DNA, 20 bp, mouse
gcccgggagccggcagggag

SEQ ID NO: 836756 - DNA, 20 bp, mouse
gcggcctgagcgcgcgtaag

SEQ ID NO: 836757 - DNA, 20 bp, mouse
gagtctctggggctggaaac

SEQ ID NO: 836758 - DNA, 20 bp, mouse
ggtcccgccgcgggagtctc

SEQ ID NO: 836759 - DNA, 20 bp, mouse
ggcccccggctcgcctccta

SEQ ID NO: 836760 - DNA, 20 bp, mouse
ggggcactcgtcacagccat

SEQ ID NO: 836761 - DNA, 20 bp, mouse
gcacgcagccaccgggagct

SEQ ID NO: 836762 - DNA, 20 bp, mouse
gcgggtgcacacatattcct

SEQ ID NO: 836763 - DNA, 20 bp, mouse
gtgcggagatgggtgcggga

SEQ ID NO: 836764 - DNA, 20 bp, mouse
gtcctccgggataaggacga

SEQ ID NO: 836765 - DNA, 20 bp, mouse
gccgggggcggggagaaaga

SEQ ID NO: 836766 - DNA, 20 bp, mouse
ggggccgcctcgcccatctg

SEQ ID NO: 836767 - DNA, 20 bp, mouse
ggtaacgggattccacccac

SEQ ID NO: 836768 - DNA, 20 bp, mouse
gcaaagcaaagtgtgggtga

SEQ ID NO: 836769 - DNA, 20 bp, mouse
gtccagcagcctatcgtaac

SEQ ID NO: 836770 - DNA, 20 bp, mouse
gcctggcagcggcgactctc

SEQ ID NO: 836771 - DNA, 20 bp, mouse
ggaggaccggggaagtccgc

SEQ ID NO: 836772 - DNA, 20 bp, mouse
gtcgaagcaaagcaaagtgt

SEQ ID NO: 836773 - DNA, 20 bp, mouse
gcccatctgaggaattttat

SEQ ID NO: 836774 - DNA, 20 bp, mouse
gggtggaatcccgttacgat

SEQ ID NO: 836775 - DNA, 20 bp, mouse
gtgggtgacggaaacttcaa

SEQ ID NO: 836776 - DNA, 20 bp, mouse
gggctctcataagtagtcag

SEQ ID NO: 836777 - DNA, 20 bp, mouse
ggtatcagaggcaaggaact

SEQ ID NO: 836778 - DNA, 20 bp, mouse
gaaggaactaggtttgtggg

SEQ ID NO: 836779 - DNA, 20 bp, mouse
gggcaaggaactaggtttgt

SEQ ID NO: 836780 - DNA, 20 bp, mouse
gttcttacatagatgttaca

SEQ ID NO: 836781 - DNA, 20 bp, mouse
gaaatttgaccaaggtgaga

SEQ ID NO: 836782 - DNA, 20 bp, mouse
gaagtagtcagtggattata

SEQ ID NO: 836783 - DNA, 20 bp, mouse
gggtcaaatttcagtcagag

SEQ ID NO: 836784 - DNA, 20 bp, mouse
gttcttgagagagactagct

SEQ ID NO: 836785 - DNA, 20 bp, mouse
gcatatgacaagttaatggg

SEQ ID NO: 836786 - DNA, 20 bp, mouse
ggggccgccgtaatcatgaa

SEQ ID NO: 836787 - DNA, 20 bp, mouse
ggggcggcggccgtcggtgg

SEQ ID NO: 836788 - DNA, 20 bp, mouse
gtggcggcagcttccggccc

SEQ ID NO: 836789 - DNA, 20 bp, mouse
ggcagcttccggcccaggag

SEQ ID NO: 836790 - DNA, 20 bp, mouse
gaatcgcgagacgcagtcga

SEQ ID NO: 836791 - DNA, 20 bp, mouse
ggagacgcagtcgacggagc

SEQ ID NO: 836792 - DNA, 20 bp, mouse
gacggcggcccctcctgggc

SEQ ID NO: 836793 - DNA, 20 bp, mouse
gctgcagctgcgggacacgg

SEQ ID NO: 836794 - DNA, 20 bp, mouse
gccggggcggcggccgtcgg

SEQ ID NO: 836795 - DNA, 20 bp, mouse
gggtgtgcggcgcacttagg

SEQ ID NO: 836796 - DNA, 20 bp, mouse
gtggtcgggcctagaagctg

SEQ ID NO: 836797 - DNA, 20 bp, mouse
ggaggcgcccagtttccggt

SEQ ID NO: 836798 - DNA, 20 bp, mouse
gaagctgctggcggaggaca

SEQ ID NO: 836799 - DNA, 20 bp, mouse
gtaccgctagaagctgctgg

SEQ ID NO: 836800 - DNA, 20 bp, mouse
gtcaacacaggctaagaaca

SEQ ID NO: 836801 - DNA, 20 bp, mouse
gggaaaagcccccactggtc

SEQ ID NO: 836802 - DNA, 20 bp, mouse
gcgtgctcctggctctaaaa

SEQ ID NO: 836803 - DNA, 20 bp, mouse
gagcacgcccaccggaaact

SEQ ID NO: 836804 - DNA, 20 bp, mouse
ggaggtggaaaagcccccac

SEQ ID NO: 836805 - DNA, 20 bp, mouse
gcttctaggcccgaccagtg

SEQ ID NO: 836806 - DNA, 20 bp, mouse
gcaagcgcgctctgacctaa

SEQ ID NO: 836807 - DNA, 20 bp, mouse
gccagtgaagcgctgctcaa

SEQ ID NO: 836808 - DNA, 20 bp, mouse
gctgaaggggagggttttag

SEQ ID NO: 836809 - DNA, 20 bp, mouse
gtgggtccgccaatagggtc

SEQ ID NO: 836810 - DNA, 20 bp, mouse
gggcagcagccagaccctat

SEQ ID NO: 836811 - DNA, 20 bp, mouse
gagcctacggcccagttaac

SEQ ID NO: 836812 - DNA, 20 bp, mouse
gttcactgggtccgccaata

SEQ ID NO: 836813 - DNA, 20 bp, mouse
gtccaatgagaacgctgaag

SEQ ID NO: 836814 - DNA, 20 bp, mouse
gagcgcgcttgcccaattgg

SEQ ID NO: 836815 - DNA, 20 bp, mouse
gtccccttcagcgttctcat

SEQ ID NO: 836816 - DNA, 20 bp, mouse
gtgcccctggtcatcagata

SEQ ID NO: 836817 - DNA, 20 bp, mouse
ggcccagaggccatagtaga

SEQ ID NO: 836818 - DNA, 20 bp, mouse
ggtggcaagtaccagagggg

SEQ ID NO: 836819 - DNA, 20 bp, mouse
gcaagcgtctgggccaagaa

SEQ ID NO: 836820 - DNA, 20 bp, mouse
gggggtggcaagtaccagag

SEQ ID NO: 836821 - DNA, 20 bp, mouse
gggccctatctgatgaccag

SEQ ID NO: 836822 - DNA, 20 bp, mouse
gctgggtctaatggagcgga

SEQ ID NO: 836823 - DNA, 20 bp, mouse
gaaccctctactatggcctc

SEQ ID NO: 836824 - DNA, 20 bp, mouse
gaggccaccagcctcccctc

SEQ ID NO: 836825 - DNA, 20 bp, mouse
gtcctccaagcttggattgg

SEQ ID NO: 836826 - DNA, 20 bp, mouse
gtgacctgtggtcatcagaa

SEQ ID NO: 836827 - DNA, 20 bp, mouse
gcatcagaagggcatctggg

SEQ ID NO: 836828 - DNA, 20 bp, mouse
gataggagagtcaggtagtg

SEQ ID NO: 836829 - DNA, 20 bp, mouse
gggtggggacacatgttaca

SEQ ID NO: 836830 - DNA, 20 bp, mouse
gcggttgagtgcacaatgag

SEQ ID NO: 836831 - DNA, 20 bp, mouse
gagaagggcatctgggtggt

SEQ ID NO: 836832 - DNA, 20 bp, mouse
gcactcaaccgtgtgacctg

SEQ ID NO: 836833 - DNA, 20 bp, mouse
gctgatgaccacaggtcaca

SEQ ID NO: 836834 - DNA, 20 bp, mouse
gtggaaaggggtatcttctg

SEQ ID NO: 836835 - DNA, 20 bp, mouse
gcctccacatcaggagacct

SEQ ID NO: 836836 - DNA, 20 bp, mouse
gcccacccatctcacaatca

SEQ ID NO: 836837 - DNA, 20 bp, mouse
ggccccccccatcttcacta

SEQ ID NO: 836838 - DNA, 20 bp, mouse
gatgacacctagcactgggt

SEQ ID NO: 836839 - DNA, 20 bp, mouse
gtcacagtgaatctgatggg

SEQ ID NO: 836840 - DNA, 20 bp, mouse
gcccccatcttcactaagga

SEQ ID NO: 836841 - DNA, 20 bp, mouse
ggggtggcagcactctgata

SEQ ID NO: 836842 - DNA, 20 bp, mouse
gtgtgaccctgattgtgaga

SEQ ID NO: 836843 - DNA, 20 bp, mouse
ggtgggaggatgcagagtgg

SEQ ID NO: 836844 - DNA, 20 bp, mouse
gatggagccctcatccttga

SEQ ID NO: 836845 - DNA, 20 bp, mouse
gttcactaaggatggctgaa

SEQ ID NO: 836846 - DNA, 20 bp, mouse
gcagaaagggacacattcaa

SEQ ID NO: 836847 - DNA, 20 bp, mouse
ggggttgtggtgtggacagt

SEQ ID NO: 836848 - DNA, 20 bp, mouse
gcttaaagagggagcattgg

SEQ ID NO: 836849 - DNA, 20 bp, mouse
gcacctgccacagggtggga

SEQ ID NO: 836850 - DNA, 20 bp, mouse
gaatgtgtccctttctgcca

SEQ ID NO: 836851 - DNA, 20 bp, mouse
ggtggtgccctctatacact

SEQ ID NO: 836852 - DNA, 20 bp, mouse
gcctccctgtggtgtgcaat

SEQ ID NO: 836853 - DNA, 20 bp, mouse
gacacccaaccttggcagaa

SEQ ID NO: 836854 - DNA, 20 bp, mouse
gaatggcacagaacatagca

SEQ ID NO: 836855 - DNA, 20 bp, mouse
gggtggagttaggagaccca

SEQ ID NO: 836856 - DNA, 20 bp, mouse
ggggtggggtctgacatccg

SEQ ID NO: 836857 - DNA, 20 bp, mouse
gagccggtggcctaactgga

SEQ ID NO: 836858 - DNA, 20 bp, mouse
ggcttgagagagagcccgcg

SEQ ID NO: 836859 - DNA, 20 bp, mouse
gcggaaccgacaaatcagag

SEQ ID NO: 836860 - DNA, 20 bp, mouse
gcccggctgcgggtagccta

SEQ ID NO: 836861 - DNA, 20 bp, mouse
gagccaggagctgcggggtg

SEQ ID NO: 836862 - DNA, 20 bp, mouse
gaaccgacaaatcagagagg

SEQ ID NO: 836863 - DNA, 20 bp, mouse
gagatcccgcggccacgcgg

SEQ ID NO: 836864 - DNA, 20 bp, mouse
gtcccctccagttaggccac

SEQ ID NO: 836865 - DNA, 20 bp, mouse
gtttgtcgaactcgcaaaaa

SEQ ID NO: 836866 - DNA, 20 bp, mouse
ggctagagccgcgacactcc

SEQ ID NO: 836867 - DNA, 20 bp, mouse
gcaggcttgcccagagggtt

SEQ ID NO: 836868 - DNA, 20 bp, mouse
gacactccaggcttgcccag

SEQ ID NO: 836869 - DNA, 20 bp, mouse
gcgtgtgggcagggcctatc

SEQ ID NO: 836870 - DNA, 20 bp, mouse
gagggcggggcaacgctgga

SEQ ID NO: 836871 - DNA, 20 bp, mouse
ggtcccgcccccaaccctct

SEQ ID NO: 836872 - DNA, 20 bp, mouse
gtggcggaggccgtgcgtgt

SEQ ID NO: 836873 - DNA, 20 bp, mouse
gcgccatgacgcaaggggtg

SEQ ID NO: 836874 - DNA, 20 bp, mouse
gcagcaagctctaacggcag

SEQ ID NO: 836875 - DNA, 20 bp, mouse
ggcgctagaggggaagctag

SEQ ID NO: 836876 - DNA, 20 bp, mouse
gtctcagaggaccctggagg

SEQ ID NO: 836877 - DNA, 20 bp, mouse
gggtagggatggcttctcag

SEQ ID NO: 836878 - DNA, 20 bp, mouse
gagacctccagccagagcaa

SEQ ID NO: 836879 - DNA, 20 bp, mouse
ggggtgggatcaaaggaaca

SEQ ID NO: 836880 - DNA, 20 bp, mouse
gaagccatccctacctatat

SEQ ID NO: 836881 - DNA, 20 bp, mouse
ggcttctcagaggaccctgg

SEQ ID NO: 836882 - DNA, 20 bp, mouse
gggcagagggacccttgctc

SEQ ID NO: 836883 - DNA, 20 bp, mouse
gcatgtcaggagagagtgca

SEQ ID NO: 836884 - DNA, 20 bp, mouse
gtggctggaggtctggtcct

SEQ ID NO: 836885 - DNA, 20 bp, mouse
ggagagtgcatggcgccctc

SEQ ID NO: 836886 - DNA, 20 bp, mouse
gtgggtgcgcggggcaacgg

SEQ ID NO: 836887 - DNA, 20 bp, mouse
gcccccggaactgtcgtcag

SEQ ID NO: 836888 - DNA, 20 bp, mouse
gtgaacgcagggcggtgcgg

SEQ ID NO: 836889 - DNA, 20 bp, mouse
gggccccgggagggcatccg

SEQ ID NO: 836890 - DNA, 20 bp, mouse
gactctgctgggacacaatg

SEQ ID NO: 836891 - DNA, 20 bp, mouse
gtgtgcggatagtgcgcccg

SEQ ID NO: 836892 - DNA, 20 bp, mouse
gcgcccggccggccccggga

SEQ ID NO: 836893 - DNA, 20 bp, mouse
gtgtgtcccagcagagtccc

SEQ ID NO: 836894 - DNA, 20 bp, mouse
ggggcatgctgggacgggaa

SEQ ID NO: 836895 - DNA, 20 bp, mouse
ggctacgcccggccggcccc

SEQ ID NO: 836896 - DNA, 20 bp, mouse
gtggagtagtaggagaggga

SEQ ID NO: 836897 - DNA, 20 bp, mouse
gtcaagacagccagaatctt

SEQ ID NO: 836898 - DNA, 20 bp, mouse
ggaagtggagtagtaggaga

SEQ ID NO: 836899 - DNA, 20 bp, mouse
gtcttgagattgctgtgaac

SEQ ID NO: 836900 - DNA, 20 bp, mouse
ggataaagaccttggggtga

SEQ ID NO: 836901 - DNA, 20 bp, mouse
gaaccacaaaccaaagattc

SEQ ID NO: 836902 - DNA, 20 bp, mouse
ggggagttttagaggttagg

SEQ ID NO: 836903 - DNA, 20 bp, mouse
gagccagaatctttggtttg

SEQ ID NO: 836904 - DNA, 20 bp, mouse
gccagggagttttagaggtt

SEQ ID NO: 836905 - DNA, 20 bp, mouse
gagcaacagataaagacctt

SEQ ID NO: 836906 - DNA, 20 bp, mouse
gtggtctcttgcacggaggg

SEQ ID NO: 836907 - DNA, 20 bp, mouse
gggcgggacaagatgataac

SEQ ID NO: 836908 - DNA, 20 bp, mouse
gcaaaaccaaataggagcag

SEQ ID NO: 836909 - DNA, 20 bp, mouse
gcggagggtggcgcattgaa

SEQ ID NO: 836910 - DNA, 20 bp, mouse
gcgtcaggactcaactggta

SEQ ID NO: 836911 - DNA, 20 bp, mouse
gagagaccacatttctctga

SEQ ID NO: 836912 - DNA, 20 bp, mouse
gggtgtcgctgaattttctg

SEQ ID NO: 836913 - DNA, 20 bp, mouse
gagcgacaccggaagttggg

SEQ ID NO: 836914 - DNA, 20 bp, mouse
gggcagggtttgttggcttc

SEQ ID NO: 836915 - DNA, 20 bp, mouse
gaacgcaccaatcagagagc

SEQ ID NO: 836916 - DNA, 20 bp, mouse
ggcctagcgcgggagattgg

SEQ ID NO: 836917 - DNA, 20 bp, mouse
gttgctgtttggcgttgggt

SEQ ID NO: 836918 - DNA, 20 bp, mouse
gtgtccgcctggcctagcgc

SEQ ID NO: 836919 - DNA, 20 bp, mouse
ggacacaaagcctcccgggg

SEQ ID NO: 836920 - DNA, 20 bp, mouse
gagagcttgctgtttggcgt

SEQ ID NO: 836921 - DNA, 20 bp, mouse
gccccggcgcctgacgtcaa

SEQ ID NO: 836922 - DNA, 20 bp, mouse
gctggcctagcgcgggagat

SEQ ID NO: 836923 - DNA, 20 bp, mouse
ggcggacacaaagcctcccg

SEQ ID NO: 836924 - DNA, 20 bp, mouse
gggggggggggcagatactg

SEQ ID NO: 836925 - DNA, 20 bp, mouse
ggggataaggaaaactcagc

SEQ ID NO: 836926 - DNA, 20 bp, mouse
gtacccggccacagcgtggc

SEQ ID NO: 836927 - DNA, 20 bp, mouse
ggtaaggtagacgtcacgtc

SEQ ID NO: 836928 - DNA, 20 bp, mouse
gtggccgggtactaggggag

SEQ ID NO: 836929 - DNA, 20 bp, mouse
gacgctgtggccgggtacta

SEQ ID NO: 836930 - DNA, 20 bp, mouse
gaaggcgcgtcgaagtggga

SEQ ID NO: 836931 - DNA, 20 bp, mouse
gtagacgtcacgtccggttt

SEQ ID NO: 836932 - DNA, 20 bp, mouse
gtgcctttgggcgtctgttg

SEQ ID NO: 836933 - DNA, 20 bp, mouse
gcctcccctcccctagtacc

SEQ ID NO: 836934 - DNA, 20 bp, mouse
ggcaggggcgcttcccaaac

SEQ ID NO: 836935 - DNA, 20 bp, mouse
gcaggaaagcgcgccttcgg

SEQ ID NO: 836936 - DNA, 20 bp, mouse
gcccgccggggtctaagcgc

SEQ ID NO: 836937 - DNA, 20 bp, mouse
gtggaccgggacagaagcta

SEQ ID NO: 836938 - DNA, 20 bp, mouse
ggagccctgcgcttagaccc

SEQ ID NO: 836939 - DNA, 20 bp, mouse
gtgccgggaaacacctccca

SEQ ID NO: 836940 - DNA, 20 bp, mouse
gcaccacggcctggagtcta

SEQ ID NO: 836941 - DNA, 20 bp, mouse
gggccctgggaggtgtttcc

SEQ ID NO: 836942 - DNA, 20 bp, mouse
gtcccggtccagtgcgctga

SEQ ID NO: 836943 - DNA, 20 bp, mouse
gcaggcgagtctgtgtgacg

SEQ ID NO: 836944 - DNA, 20 bp, mouse
gcgcaactccagttcaccgc

SEQ ID NO: 836945 - DNA, 20 bp, mouse
gccagcaccccgcggtgaac

SEQ ID NO: 836946 - DNA, 20 bp, mouse
gagctcgctccgactccctg

SEQ ID NO: 836947 - DNA, 20 bp, mouse
ggggcatggcaggcgctcgc

SEQ ID NO: 836948 - DNA, 20 bp, mouse
gcgagctcggcgcccgggcg

SEQ ID NO: 836949 - DNA, 20 bp, mouse
gcggcgaggcggggtctgcc

SEQ ID NO: 836950 - DNA, 20 bp, mouse
gtccctccgcgcgcgtgcga

SEQ ID NO: 836951 - DNA, 20 bp, mouse
gcccccgagcccggctcaga

SEQ ID NO: 836952 - DNA, 20 bp, mouse
gtccctcgcacgcgcgcgga

SEQ ID NO: 836953 - DNA, 20 bp, mouse
ggcgcgcagtgggacaagtg

SEQ ID NO: 836954 - DNA, 20 bp, mouse
ggctccgccatgctgctccg

SEQ ID NO: 836955 - DNA, 20 bp, mouse
gcgagcccggctcagagggg

SEQ ID NO: 836956 - DNA, 20 bp, mouse
gtggccacggaggacagcta

SEQ ID NO: 836957 - DNA, 20 bp, mouse
gttacccggagacaggggac

SEQ ID NO: 836958 - DNA, 20 bp, mouse
gggacccggcgactctgcta

SEQ ID NO: 836959 - DNA, 20 bp, mouse
ggggctttacccggagacag

SEQ ID NO: 836960 - DNA, 20 bp, mouse
ggacaggggactggccacgg

SEQ ID NO: 836961 - DNA, 20 bp, mouse
gcggagaaggcgggacgcgc

SEQ ID NO: 836962 - DNA, 20 bp, mouse
gcgtcctgccatctaaactt

SEQ ID NO: 836963 - DNA, 20 bp, mouse
gggtgccctagcagagtcgc

SEQ ID NO: 836964 - DNA, 20 bp, mouse
gcgtcccgccttctccgccc

SEQ ID NO: 836965 - DNA, 20 bp, mouse
gacggacacccaagtttaga

SEQ ID NO: 836966 - DNA, 20 bp, mouse
gtgagctgggctggcttcgg

SEQ ID NO: 836967 - DNA, 20 bp, mouse
gaactggagtgcttctgttg

SEQ ID NO: 836968 - DNA, 20 bp, mouse
gtcaggagtgcagccactga

SEQ ID NO: 836969 - DNA, 20 bp, mouse
gactcctagcattccatcag

SEQ ID NO: 836970 - DNA, 20 bp, mouse
ggccttgcggcacttcaggc

SEQ ID NO: 836971 - DNA, 20 bp, mouse
ggctgatcgctcctccctca

SEQ ID NO: 836972 - DNA, 20 bp, mouse
gctaggagtcagctagcacc

SEQ ID NO: 836973 - DNA, 20 bp, mouse
ggggtgggactgagctgggc

SEQ ID NO: 836974 - DNA, 20 bp, mouse
gaagtgccgcaaggcaagag

SEQ ID NO: 836975 - DNA, 20 bp, mouse
gtcggaggctggccgggggg

SEQ ID NO: 836976 - DNA, 20 bp, mouse
gtgttccagaggtactgggg

SEQ ID NO: 836977 - DNA, 20 bp, mouse
gaaggcagcccgtggttctc

SEQ ID NO: 836978 - DNA, 20 bp, mouse
ggcagcccgtggttctcagg

SEQ ID NO: 836979 - DNA, 20 bp, mouse
ggtccgggaggagatagaga

SEQ ID NO: 836980 - DNA, 20 bp, mouse
gtctcactctgaaaagtgtc

SEQ ID NO: 836981 - DNA, 20 bp, mouse
gaaaaaaatcccctggacag

SEQ ID NO: 836982 - DNA, 20 bp, mouse
gacccttggtggagaggcca

SEQ ID NO: 836983 - DNA, 20 bp, mouse
ggaggaagagagtagtgccc

SEQ ID NO: 836984 - DNA, 20 bp, mouse
gggaggaattgtgactctgc

SEQ ID NO: 836985 - DNA, 20 bp, mouse
gtctcctcccggacccttgg

SEQ ID NO: 836986 - DNA, 20 bp, mouse
ggactgacgtccacgaagag

SEQ ID NO: 836987 - DNA, 20 bp, mouse
gacggaagcaggaacctacc

SEQ ID NO: 836988 - DNA, 20 bp, mouse
ggactctgcccgctgacaga

SEQ ID NO: 836989 - DNA, 20 bp, mouse
gaacctaccaggaacgagca

SEQ ID NO: 836990 - DNA, 20 bp, mouse
gagcacggaaccgcagagag

SEQ ID NO: 836991 - DNA, 20 bp, mouse
ggactaatcaccgctctctg

SEQ ID NO: 836992 - DNA, 20 bp, mouse
ggagcggtgattagtcagag

SEQ ID NO: 836993 - DNA, 20 bp, mouse
gtcctgcttccgtctgtcag

SEQ ID NO: 836994 - DNA, 20 bp, mouse
gttccgtgctcgttcctggt

SEQ ID NO: 836995 - DNA, 20 bp, mouse
gtctgtccgtcagacggggc

SEQ ID NO: 836996 - DNA, 20 bp, mouse
gcgccagccgaaggggatga

SEQ ID NO: 836997 - DNA, 20 bp, mouse
gcgggcgcgcgccagccgaa

SEQ ID NO: 836998 - DNA, 20 bp, mouse
ggcgcccgcgcccgttgcta

SEQ ID NO: 836999 - DNA, 20 bp, mouse
gggaggggccagggccctga

SEQ ID NO: 837000 - DNA, 20 bp, mouse
gtcgccgccggccttagcaa

SEQ ID NO: 837001 - DNA, 20 bp, mouse
gggtccctagcaacgggcgc

SEQ ID NO: 837002 - DNA, 20 bp, mouse
gagaggaagtgccagcgcga

SEQ ID NO: 837003 - DNA, 20 bp, mouse
ggcgcgcgccgccgttgcta

SEQ ID NO: 837004 - DNA, 20 bp, mouse
ggccgagggtccctagcaac

SEQ ID NO: 837005 - DNA, 20 bp, mouse
gccgccgttgctaaggccgg

SEQ ID NO: 837006 - DNA, 20 bp, mouse
gcacacgcgctccgcctctg

SEQ ID NO: 837007 - DNA, 20 bp, mouse
gtagagaggccggaggggat

SEQ ID NO: 837008 - DNA, 20 bp, mouse
gaggccggaggggatgggcg

SEQ ID NO: 837009 - DNA, 20 bp, mouse
ggcagctagagaggccggag

SEQ ID NO: 837010 - DNA, 20 bp, mouse
ggggttggcggagcaggctc

SEQ ID NO: 837011 - DNA, 20 bp, mouse
gcaagcgcggtggcgagctg

SEQ ID NO: 837012 - DNA, 20 bp, mouse
ggccctatggtgcgccgggt

SEQ ID NO: 837013 - DNA, 20 bp, mouse
gtcctccagagcagctagag

SEQ ID NO: 837014 - DNA, 20 bp, mouse
gctgcggtgcactgtgggat

SEQ ID NO: 837015 - DNA, 20 bp, mouse
ggtggcacgcgcaagcgcgg

SEQ ID NO: 837016 - DNA, 20 bp, mouse
gcctgggcctgataatggga

SEQ ID NO: 837017 - DNA, 20 bp, mouse
gaaactgtgaggaatgcccc

SEQ ID NO: 837018 - DNA, 20 bp, mouse
gaagcaggatgcagcctaat

SEQ ID NO: 837019 - DNA, 20 bp, mouse
gctccgggagacaccttctc

SEQ ID NO: 837020 - DNA, 20 bp, mouse
gtctctctggtgaacgcaag

SEQ ID NO: 837021 - DNA, 20 bp, mouse
gacccagataagaaactgtg

SEQ ID NO: 837022 - DNA, 20 bp, mouse
gaggaatgccccgggcttct

SEQ ID NO: 837023 - DNA, 20 bp, mouse
gcgcctgagaaggtgtctcc

SEQ ID NO: 837024 - DNA, 20 bp, mouse
gatgcagcctaattggttgc

SEQ ID NO: 837025 - DNA, 20 bp, mouse
gcgagcctgggcctgataat

SEQ ID NO: 837026 - DNA, 20 bp, mouse
gcaatcaggtagttggagag

SEQ ID NO: 837027 - DNA, 20 bp, mouse
ggagctacagcaccaaccag

SEQ ID NO: 837028 - DNA, 20 bp, mouse
gctggtgaggaagtccaccc

SEQ ID NO: 837029 - DNA, 20 bp, mouse
gggccctctcaaattgctaa

SEQ ID NO: 837030 - DNA, 20 bp, mouse
gagcagaccaatcaggtagt

SEQ ID NO: 837031 - DNA, 20 bp, mouse
gaagtggcaaggtatagata

SEQ ID NO: 837032 - DNA, 20 bp, mouse
gaccagaggaagtgaatact

SEQ ID NO: 837033 - DNA, 20 bp, mouse
gtggacttcctcaccagccc

SEQ ID NO: 837034 - DNA, 20 bp, mouse
ggccagagagcagaccaatc

SEQ ID NO: 837035 - DNA, 20 bp, mouse
gtggaggggtgaaatatgga

SEQ ID NO: 837036 - DNA, 20 bp, mouse
gagtctatctctctgggtca

SEQ ID NO: 837037 - DNA, 20 bp, mouse
ggagggaggagtcagaagat

SEQ ID NO: 837038 - DNA, 20 bp, mouse
gtgggtggcttgtagaactg

SEQ ID NO: 837039 - DNA, 20 bp, mouse
gctgccagatgccaagaggg

SEQ ID NO: 837040 - DNA, 20 bp, mouse
ggaacaggtgcaatccggta

SEQ ID NO: 837041 - DNA, 20 bp, mouse
ggtcagggtggaagtagcac

SEQ ID NO: 837042 - DNA, 20 bp, mouse
gactgacagtctatctctct

SEQ ID NO: 837043 - DNA, 20 bp, mouse
gggttcttaatacacatgga

SEQ ID NO: 837044 - DNA, 20 bp, mouse
gccaaacacaacaggtgctc

SEQ ID NO: 837045 - DNA, 20 bp, mouse
gggatctgccagatgccaag

SEQ ID NO: 837046 - DNA, 20 bp, mouse
gtgcgggcggcgccgactgg

SEQ ID NO: 837047 - DNA, 20 bp, mouse
gcattcggagtgaggggttg

SEQ ID NO: 837048 - DNA, 20 bp, mouse
gagtgggcggggcacgaggg

SEQ ID NO: 837049 - DNA, 20 bp, mouse
gcgacagcattcggagtgag

SEQ ID NO: 837050 - DNA, 20 bp, mouse
gaccccgcccgccggaagag

SEQ ID NO: 837051 - DNA, 20 bp, mouse
gcccgctggaactccgagtg

SEQ ID NO: 837052 - DNA, 20 bp, mouse
gtggcggccgagaccggccc

SEQ ID NO: 837053 - DNA, 20 bp, mouse
ggctccgccccctcttccgg

SEQ ID NO: 837054 - DNA, 20 bp, mouse
gcgcactccgaactctgccc

SEQ ID NO: 837055 - DNA, 20 bp, mouse
ggggcacgagggcgggctct

SEQ ID NO: 837056 - DNA, 20 bp, mouse
ggaggggcggggctgacgat

SEQ ID NO: 837057 - DNA, 20 bp, mouse
gggcgtgaggcttctgacag

SEQ ID NO: 837058 - DNA, 20 bp, mouse
ggcctcacgccccgccgctt

SEQ ID NO: 837059 - DNA, 20 bp, mouse
gcaagaggcagggctgaagg

SEQ ID NO: 837060 - DNA, 20 bp, mouse
gagggctgaaggtggaggcg

SEQ ID NO: 837061 - DNA, 20 bp, mouse
gcatcctcggccctgcctct

SEQ ID NO: 837062 - DNA, 20 bp, mouse
gctcccgagaggcagggccg

SEQ ID NO: 837063 - DNA, 20 bp, mouse
gccagcggcgggctccggga

SEQ ID NO: 837064 - DNA, 20 bp, mouse
gctccgctggcgccctacgg

SEQ ID NO: 837065 - DNA, 20 bp, mouse
gggtcatggcgcccaagcgg

SEQ ID NO: 837066 - DNA, 20 bp, mouse
gagaggccgccccctgtctg

SEQ ID NO: 837067 - DNA, 20 bp, mouse
ggggctacgtgattaatgta

SEQ ID NO: 837068 - DNA, 20 bp, mouse
gtgcgaggaagggcggggta

SEQ ID NO: 837069 - DNA, 20 bp, mouse
gagcgcgccccgggacaaag

SEQ ID NO: 837070 - DNA, 20 bp, mouse
gaaaacttctttgcgaggaa

SEQ ID NO: 837071 - DNA, 20 bp, mouse
gtaatcacgtagcccttcct

SEQ ID NO: 837072 - DNA, 20 bp, mouse
gcgtggaggaccacagacag

SEQ ID NO: 837073 - DNA, 20 bp, mouse
ggcggggtaaggcttcagcg

SEQ ID NO: 837074 - DNA, 20 bp, mouse
gcgtgacaatgttggagaat

SEQ ID NO: 837075 - DNA, 20 bp, mouse
gagctcgctaggagcagcaa

SEQ ID NO: 837076 - DNA, 20 bp, mouse
ggacctctgtactgaaggac

SEQ ID NO: 837077 - DNA, 20 bp, mouse
gttgcacattggaatttgat

SEQ ID NO: 837078 - DNA, 20 bp, mouse
gccggcgacctctgtactga

SEQ ID NO: 837079 - DNA, 20 bp, mouse
gactcaatggctctacaacc

SEQ ID NO: 837080 - DNA, 20 bp, mouse
gctgtactgaaggaccggat

SEQ ID NO: 837081 - DNA, 20 bp, mouse
gtcgtcactcatggactcaa

SEQ ID NO: 837082 - DNA, 20 bp, mouse
gtcgaggagcatatcagcag

SEQ ID NO: 837083 - DNA, 20 bp, mouse
gtacaggagccggaagtccc

SEQ ID NO: 837084 - DNA, 20 bp, mouse
gaggtggcccaatcacataa

SEQ ID NO: 837085 - DNA, 20 bp, mouse
gtacgattggtggaaattgc

SEQ ID NO: 837086 - DNA, 20 bp, mouse
gtgggctcggaggtgaacgg

SEQ ID NO: 837087 - DNA, 20 bp, mouse
gtgggcagctgggcggttgt

SEQ ID NO: 837088 - DNA, 20 bp, mouse
gcctcggcgacggtgggaag

SEQ ID NO: 837089 - DNA, 20 bp, mouse
ggccagccgtggggccctga

SEQ ID NO: 837090 - DNA, 20 bp, mouse
ggcagatgagcctacgatga

SEQ ID NO: 837091 - DNA, 20 bp, mouse
gacgcccattggccagccgt

SEQ ID NO: 837092 - DNA, 20 bp, mouse
ggggccccacggctggccaa

SEQ ID NO: 837093 - DNA, 20 bp, mouse
ggggcccgggcggttggagc

SEQ ID NO: 837094 - DNA, 20 bp, mouse
gcggtgacgcaggctcgcgg

SEQ ID NO: 837095 - DNA, 20 bp, mouse
gcggcccgctccaaccgccc

SEQ ID NO: 837096 - DNA, 20 bp, mouse
gtagctccttcgggtctcct

SEQ ID NO: 837097 - DNA, 20 bp, mouse
ggaaacagggacccactccc

SEQ ID NO: 837098 - DNA, 20 bp, mouse
ggggttttgcggtagaaaca

SEQ ID NO: 837099 - DNA, 20 bp, mouse
gaagcagcccgccagccgtg

SEQ ID NO: 837100 - DNA, 20 bp, mouse
gaggggatcgcagggttttg

SEQ ID NO: 837101 - DNA, 20 bp, mouse
gactggaatgccaagaaaag

SEQ ID NO: 837102 - DNA, 20 bp, mouse
gagtgcagcaagaaggggtc

SEQ ID NO: 837103 - DNA, 20 bp, mouse
ggattggacaaacttcgggg

SEQ ID NO: 837104 - DNA, 20 bp, mouse
gcccgaaggagctaaatccc

SEQ ID NO: 837105 - DNA, 20 bp, mouse
gcgccagccgtgcggaatcc

SEQ ID NO: 837106 - DNA, 20 bp, mouse
gagctctttgtggattctga

SEQ ID NO: 837107 - DNA, 20 bp, mouse
gtggcggggagggattacag

SEQ ID NO: 837108 - DNA, 20 bp, mouse
gagtgccaggtggcgtccca

SEQ ID NO: 837109 - DNA, 20 bp, mouse
gtaagccctgggacgccacc

SEQ ID NO: 837110 - DNA, 20 bp, mouse
gacaacacgacacctctcta

SEQ ID NO: 837111 - DNA, 20 bp, mouse
gctctagggtggggcgggtg

SEQ ID NO: 837112 - DNA, 20 bp, mouse
gacaaccaagggcgagggaa

SEQ ID NO: 837113 - DNA, 20 bp, mouse
gaaaatgcaaacgcgttctc

SEQ ID NO: 837114 - DNA, 20 bp, mouse
gtatgcccgggagctctttg

SEQ ID NO: 837115 - DNA, 20 bp, mouse
ggctgccccgggacgcacag

SEQ ID NO: 837116 - DNA, 20 bp, mouse
gagaagctggaggcgcggtg

SEQ ID NO: 837117 - DNA, 20 bp, mouse
gccccgaccccgctggggtg

SEQ ID NO: 837118 - DNA, 20 bp, mouse
ggggccctcgagctgtaggc

SEQ ID NO: 837119 - DNA, 20 bp, mouse
gcgccccaccccagcggggt

SEQ ID NO: 837120 - DNA, 20 bp, mouse
gcggggcaaccggccgggac

SEQ ID NO: 837121 - DNA, 20 bp, mouse
gtggacttctgccctagccc

SEQ ID NO: 837122 - DNA, 20 bp, mouse
gggcagcccccacccagcta

SEQ ID NO: 837123 - DNA, 20 bp, mouse
gacagggaacgcaggtcggt

SEQ ID NO: 837124 - DNA, 20 bp, mouse
gcgtcccgcctacagctcga

SEQ ID NO: 837125 - DNA, 20 bp, mouse
gcgcctccagcttctagctc

SEQ ID NO: 837126 - DNA, 20 bp, mouse
gcgccccggcggctgcgtac

SEQ ID NO: 837127 - DNA, 20 bp, mouse
gcgagcgcgcggtttcttcc

SEQ ID NO: 837128 - DNA, 20 bp, mouse
gggcccacagcgccccctgt

SEQ ID NO: 837129 - DNA, 20 bp, mouse
ggcgacctccagcccacagg

SEQ ID NO: 837130 - DNA, 20 bp, mouse
gggaggtcgcggaacgcgag

SEQ ID NO: 837131 - DNA, 20 bp, mouse
gagccagtacgcagccgccg

SEQ ID NO: 837132 - DNA, 20 bp, mouse
gtgcgtactggctgtgggat

SEQ ID NO: 837133 - DNA, 20 bp, mouse
ggggccaccaggtgcggcca

SEQ ID NO: 837134 - DNA, 20 bp, mouse
ggaagtgaagccccagcgag

SEQ ID NO: 837135 - DNA, 20 bp, mouse
gcggctgcggcggggctgtg

SEQ ID NO: 837136 - DNA, 20 bp, mouse
gaagcccctccggctcctgt

SEQ ID NO: 837137 - DNA, 20 bp, mouse
ggccgcccacccacaggagc

SEQ ID NO: 837138 - DNA, 20 bp, mouse
gtaggccgagcatgcgcaca

SEQ ID NO: 837139 - DNA, 20 bp, mouse
gaccgcccgtctgacgccca

SEQ ID NO: 837140 - DNA, 20 bp, mouse
gaccctgggcgtcagacggg

SEQ ID NO: 837141 - DNA, 20 bp, mouse
ggcgaccctgggcgtcagac

SEQ ID NO: 837142 - DNA, 20 bp, mouse
gcacccgggcctgcggggca

SEQ ID NO: 837143 - DNA, 20 bp, mouse
gatcgccgccgcccacccac

SEQ ID NO: 837144 - DNA, 20 bp, mouse
gcaaatccgcgctcgcaccc

SEQ ID NO: 837145 - DNA, 20 bp, mouse
gaatctcaccttcccttaag

SEQ ID NO: 837146 - DNA, 20 bp, mouse
gcgcgcctgtgcagccgctg

SEQ ID NO: 837147 - DNA, 20 bp, mouse
gcgagcgcggcacaagggtt

SEQ ID NO: 837148 - DNA, 20 bp, mouse
gcacagccctcgccccgcag

SEQ ID NO: 837149 - DNA, 20 bp, mouse
ggcccagcgcggaacaactt

SEQ ID NO: 837150 - DNA, 20 bp, mouse
ggcggggcgagggctgtggc

SEQ ID NO: 837151 - DNA, 20 bp, mouse
gggtagcgagcgcggcacaa

SEQ ID NO: 837152 - DNA, 20 bp, mouse
ggccaaagggcttgagggcg

SEQ ID NO: 837153 - DNA, 20 bp, mouse
gtcacggaagagtgtacccc

SEQ ID NO: 837154 - DNA, 20 bp, mouse
gcggaagagtgtacccccgg

SEQ ID NO: 837155 - DNA, 20 bp, mouse
gcgctggccaaagggcttga

SEQ ID NO: 837156 - DNA, 20 bp, mouse
gcccagggcgcgtcgaacag

SEQ ID NO: 837157 - DNA, 20 bp, mouse
ggggcccgggacccaatcag

SEQ ID NO: 837158 - DNA, 20 bp, mouse
gaagggccgcgaagtcgtga

SEQ ID NO: 837159 - DNA, 20 bp, mouse
gaagtcgtgagggtgaggcg

SEQ ID NO: 837160 - DNA, 20 bp, mouse
ggcagtggggtgccacccaa

SEQ ID NO: 837161 - DNA, 20 bp, mouse
gagtgcgtgtgtggtggcat

SEQ ID NO: 837162 - DNA, 20 bp, mouse
ggcgtcgaacagcggaagac

SEQ ID NO: 837163 - DNA, 20 bp, mouse
ggaagacaggagccggccgg

SEQ ID NO: 837164 - DNA, 20 bp, mouse
ggggtggtcctcgcgactga

SEQ ID NO: 837165 - DNA, 20 bp, mouse
gctggcacgctgcctcctgg

SEQ ID NO: 837166 - DNA, 20 bp, mouse
ggtgctggcggtccctaggc

SEQ ID NO: 837167 - DNA, 20 bp, mouse
ggcgttgcctgtgcgagaac

SEQ ID NO: 837168 - DNA, 20 bp, mouse
ggcagcaaaccgcagcgcgg

SEQ ID NO: 837169 - DNA, 20 bp, mouse
gtagggaccgccagcaccgc

SEQ ID NO: 837170 - DNA, 20 bp, mouse
gcttcagggcccccgcgctg

SEQ ID NO: 837171 - DNA, 20 bp, mouse
gcctcacacgcacaatgcaa

SEQ ID NO: 837172 - DNA, 20 bp, mouse
ggcactacccagctggagtg

SEQ ID NO: 837173 - DNA, 20 bp, mouse
ggcgcgcgacgggctgtcca

SEQ ID NO: 837174 - DNA, 20 bp, mouse
gtgtccccggcccgcggtgc

SEQ ID NO: 837175 - DNA, 20 bp, mouse
gggtagtgccatctcgagaa

SEQ ID NO: 837176 - DNA, 20 bp, mouse
gcacagcacgaggtgggagg

SEQ ID NO: 837177 - DNA, 20 bp, mouse
ggggagggtgtagtaaactc

SEQ ID NO: 837178 - DNA, 20 bp, mouse
gagcttactgttctcgtggg

SEQ ID NO: 837179 - DNA, 20 bp, mouse
gcctccggaagagttctata

SEQ ID NO: 837180 - DNA, 20 bp, mouse
gaactcttccggaggaagga

SEQ ID NO: 837181 - DNA, 20 bp, mouse
gactcagcacagcacgaggt

SEQ ID NO: 837182 - DNA, 20 bp, mouse
gacgagaacagtaagctcat

SEQ ID NO: 837183 - DNA, 20 bp, mouse
gttgcaaaacttcctaccca

SEQ ID NO: 837184 - DNA, 20 bp, mouse
gttcacacatctagcgtctt

SEQ ID NO: 837185 - DNA, 20 bp, mouse
gctaaactcagcacagcacg

SEQ ID NO: 837186 - DNA, 20 bp, mouse
gcatgcgtgcccacgttccc

SEQ ID NO: 837187 - DNA, 20 bp, mouse
ggagtctagtaagactatcg

SEQ ID NO: 837188 - DNA, 20 bp, mouse
gcaagctccccgcacatcac

SEQ ID NO: 837189 - DNA, 20 bp, mouse
gttcagaggcccgggaacgt

SEQ ID NO: 837190 - DNA, 20 bp, mouse
gcgcgcggcatcggcgacca

SEQ ID NO: 837191 - DNA, 20 bp, mouse
ggcggggagcttggtctcgc

SEQ ID NO: 837192 - DNA, 20 bp, mouse
gtgaagcccagtgatgtgcg

SEQ ID NO: 837193 - DNA, 20 bp, mouse
gacgtaattcggttggaggc

SEQ ID NO: 837194 - DNA, 20 bp, mouse
ggcgggtgacgtaattcggt

SEQ ID NO: 837195 - DNA, 20 bp, mouse
gccctcctgaagccaatccg

SEQ ID NO: 837196 - DNA, 20 bp, mouse
gtgcctgagaaccgaggcag

SEQ ID NO: 837197 - DNA, 20 bp, mouse
gcggccccgccctgcaccgc

SEQ ID NO: 837198 - DNA, 20 bp, mouse
ggccgcccggcggtgcaggg

SEQ ID NO: 837199 - DNA, 20 bp, mouse
gggcacgcggcctttttcgt

SEQ ID NO: 837200 - DNA, 20 bp, mouse
gccgctgtagctgtcaatag

SEQ ID NO: 837201 - DNA, 20 bp, mouse
gcgcctctgcctcggttctc

SEQ ID NO: 837202 - DNA, 20 bp, mouse
ggaatgccctcctacgaaaa

SEQ ID NO: 837203 - DNA, 20 bp, mouse
gagctgcagaggacagaggg

SEQ ID NO: 837204 - DNA, 20 bp, mouse
gccggggcgcgcgacttaaa

SEQ ID NO: 837205 - DNA, 20 bp, mouse
gttcgtaggagggcattcgg

SEQ ID NO: 837206 - DNA, 20 bp, mouse
gggaaccgggatcacgttaa

SEQ ID NO: 837207 - DNA, 20 bp, mouse
gggagacgcgatcgtgagaa

SEQ ID NO: 837208 - DNA, 20 bp, mouse
gagtaactggtcagaggtct

SEQ ID NO: 837209 - DNA, 20 bp, mouse
gtcacgatcgcgtctcctat

SEQ ID NO: 837210 - DNA, 20 bp, mouse
gacctctgaccagttactga

SEQ ID NO: 837211 - DNA, 20 bp, mouse
gggtaccgcccatcagtaac

SEQ ID NO: 837212 - DNA, 20 bp, mouse
gttcctagaggagaaagagt

SEQ ID NO: 837213 - DNA, 20 bp, mouse
gcccatcagtaactggtcag

SEQ ID NO: 837214 - DNA, 20 bp, mouse
ggccaccggcagtcgattgt

SEQ ID NO: 837215 - DNA, 20 bp, mouse
ggcccacaatcgactgccgg

SEQ ID NO: 837216 - DNA, 20 bp, mouse
gtggaagccgggcgcatatc

SEQ ID NO: 837217 - DNA, 20 bp, mouse
gccaaactgggtaggggaca

SEQ ID NO: 837218 - DNA, 20 bp, mouse
gctaaggccaaactgggtag

SEQ ID NO: 837219 - DNA, 20 bp, mouse
ggcggggcctaaggccaaac

SEQ ID NO: 837220 - DNA, 20 bp, mouse
gtatccggctcaagagctgt

SEQ ID NO: 837221 - DNA, 20 bp, mouse
gaagctctccactggaagcc

SEQ ID NO: 837222 - DNA, 20 bp, mouse
gcacactgccacagacacaa

SEQ ID NO: 837223 - DNA, 20 bp, mouse
gtgcggaagtcgggtctccg

SEQ ID NO: 837224 - DNA, 20 bp, mouse
gaagttgcggggaggaatta

SEQ ID NO: 837225 - DNA, 20 bp, mouse
gtaggggacaaggatggtcc

SEQ ID NO: 837226 - DNA, 20 bp, mouse
gccgtacagccaatgactga

SEQ ID NO: 837227 - DNA, 20 bp, mouse
gggggagggcgctactgtca

SEQ ID NO: 837228 - DNA, 20 bp, mouse
ggcagtgtacgcggggcagg

SEQ ID NO: 837229 - DNA, 20 bp, mouse
gccggagccggagtagacag

SEQ ID NO: 837230 - DNA, 20 bp, mouse
gaacccctcctctcagtaaa

SEQ ID NO: 837231 - DNA, 20 bp, mouse
gacggctgtggtgaaggtga

SEQ ID NO: 837232 - DNA, 20 bp, mouse
gagccggagtagacagtggg

SEQ ID NO: 837233 - DNA, 20 bp, mouse
ggcatctgcgagtaatggag

SEQ ID NO: 837234 - DNA, 20 bp, mouse
gcacgcatgcgcaggataga

SEQ ID NO: 837235 - DNA, 20 bp, mouse
gtgcgccgaggcttctgggt

SEQ ID NO: 837236 - DNA, 20 bp, mouse
ggcgggcggcgggcagtgta

SEQ ID NO: 837237 - DNA, 20 bp, mouse
ggcagtgtagggatgagcta

SEQ ID NO: 837238 - DNA, 20 bp, mouse
gactctggacggaataaaga

SEQ ID NO: 837239 - DNA, 20 bp, mouse
gcggctgcttgacgagttag

SEQ ID NO: 837240 - DNA, 20 bp, mouse
gtcctcccacggtatgggaa

SEQ ID NO: 837241 - DNA, 20 bp, mouse
gagcgcgcaggcgtcacgga

SEQ ID NO: 837242 - DNA, 20 bp, mouse
gtaagagcgcgcaggcgtca

SEQ ID NO: 837243 - DNA, 20 bp, mouse
gacaagcgagggccccgaag

SEQ ID NO: 837244 - DNA, 20 bp, mouse
gggccaaagcctgggcggtt

SEQ ID NO: 837245 - DNA, 20 bp, mouse
ggccggggcgcaggaggaga

SEQ ID NO: 837246 - DNA, 20 bp, mouse
ggtctgagtgacaagggagt

SEQ ID NO: 837247 - DNA, 20 bp, mouse
ggccctggcggcagaatgag

SEQ ID NO: 837248 - DNA, 20 bp, mouse
ggggctgggccttacgggaa

SEQ ID NO: 837249 - DNA, 20 bp, mouse
gctggcggcagaatgagagg

SEQ ID NO: 837250 - DNA, 20 bp, mouse
gagcagtagcacgatgttgg

SEQ ID NO: 837251 - DNA, 20 bp, mouse
ggcaaaccaagctcccgctg

SEQ ID NO: 837252 - DNA, 20 bp, mouse
ggcccgccctacagtccaaa

SEQ ID NO: 837253 - DNA, 20 bp, mouse
ggtcccgcccctttcccgta

SEQ ID NO: 837254 - DNA, 20 bp, mouse
gccgcccagactctcaggtc

SEQ ID NO: 837255 - DNA, 20 bp, mouse
gggagtgggctgggccttac

SEQ ID NO: 837256 - DNA, 20 bp, mouse
ggaccccgggacttgtggtt

SEQ ID NO: 837257 - DNA, 20 bp, mouse
gaatgctaccagcgcccggg

SEQ ID NO: 837258 - DNA, 20 bp, mouse
ggcagctcgagctgaatcac

SEQ ID NO: 837259 - DNA, 20 bp, mouse
gaggtggcatccgcaccttg

SEQ ID NO: 837260 - DNA, 20 bp, mouse
gggaaaataaggacactctg

SEQ ID NO: 837261 - DNA, 20 bp, mouse
ggtgtggcgcagaggacccc

SEQ ID NO: 837262 - DNA, 20 bp, mouse
gcataatggtgcagccaccc

SEQ ID NO: 837263 - DNA, 20 bp, mouse
ggtaggactaccacaaggtg

SEQ ID NO: 837264 - DNA, 20 bp, mouse
gcaccattatggccgctagg

SEQ ID NO: 837265 - DNA, 20 bp, mouse
gacatcacagtgccagtcgt

SEQ ID NO: 837266 - DNA, 20 bp, mouse
gaaaaaagaaacaacagcgt

SEQ ID NO: 837267 - DNA, 20 bp, mouse
gaaagtgatatagatctcat

SEQ ID NO: 837268 - DNA, 20 bp, mouse
gcatgtggttagaaactacc

SEQ ID NO: 837269 - DNA, 20 bp, mouse
gtaaaccctgagcccccaca

SEQ ID NO: 837270 - DNA, 20 bp, mouse
ggcaaaagaatgcagatcct

SEQ ID NO: 837271 - DNA, 20 bp, mouse
gaacagccatgtgggggctc

SEQ ID NO: 837272 - DNA, 20 bp, mouse
ggttagaaactaccaggtgt

SEQ ID NO: 837273 - DNA, 20 bp, mouse
gtggaatgagtacagaatca

SEQ ID NO: 837274 - DNA, 20 bp, mouse
gagtgccaggcttgggaaac

SEQ ID NO: 837275 - DNA, 20 bp, mouse
ggcgcttgttgcttttcccg

SEQ ID NO: 837276 - DNA, 20 bp, mouse
gaggctatgacaccagttcc

SEQ ID NO: 837277 - DNA, 20 bp, mouse
gtgcgcgtgcgctttaggag

SEQ ID NO: 837278 - DNA, 20 bp, mouse
gcctcgagagagtacttccg

SEQ ID NO: 837279 - DNA, 20 bp, mouse
gaggtggaggcgaccctaca

SEQ ID NO: 837280 - DNA, 20 bp, mouse
ggctaaactccgcctcttgt

SEQ ID NO: 837281 - DNA, 20 bp, mouse
gaggggggagggccgcagga

SEQ ID NO: 837282 - DNA, 20 bp, mouse
gaatgggtggagccacgtct

SEQ ID NO: 837283 - DNA, 20 bp, mouse
gtcacgaagcagtccgtgta

SEQ ID NO: 837284 - DNA, 20 bp, mouse
gaagtactctctcgaggcag

SEQ ID NO: 837285 - DNA, 20 bp, mouse
gaaagcgcacgcgcaagcca

SEQ ID NO: 837286 - DNA, 20 bp, mouse
gtgaccgagaggggccgcaa

SEQ ID NO: 837287 - DNA, 20 bp, mouse
ggcaatgcggtgaccgagag

SEQ ID NO: 837288 - DNA, 20 bp, mouse
gcgcccgtgtccaagccccg

SEQ ID NO: 837289 - DNA, 20 bp, mouse
gcagaacgctggtgggcact

SEQ ID NO: 837290 - DNA, 20 bp, mouse
gcacggagggcggggcaatg

SEQ ID NO: 837291 - DNA, 20 bp, mouse
gcgccgcggggcttggacac

SEQ ID NO: 837292 - DNA, 20 bp, mouse
ggccccgcggcgcagaacgc

SEQ ID NO: 837293 - DNA, 20 bp, mouse
gtaagaagatacgtgcccga

SEQ ID NO: 837294 - DNA, 20 bp, mouse
gccgcggcgcagaacgctgg

SEQ ID NO: 837295 - DNA, 20 bp, mouse
gtgagtgcgcaggcgtgcgc

SEQ ID NO: 837296 - DNA, 20 bp, mouse
gaacagcgcggccaaggaag

SEQ ID NO: 837297 - DNA, 20 bp, mouse
gtgtccgaagactcgggagc

SEQ ID NO: 837298 - DNA, 20 bp, mouse
gcgaagactcgggagcaggg

SEQ ID NO: 837299 - DNA, 20 bp, mouse
gcagggagggaagcgaagaa

SEQ ID NO: 837300 - DNA, 20 bp, mouse
gggccaaggaaggggctcgg

SEQ ID NO: 837301 - DNA, 20 bp, mouse
gtacctcccgagctgaccaa

SEQ ID NO: 837302 - DNA, 20 bp, mouse
ggcggaagatgttaacagcg

SEQ ID NO: 837303 - DNA, 20 bp, mouse
ggagtcttcggacatccaat

SEQ ID NO: 837304 - DNA, 20 bp, mouse
ggaggtaggcccgatctgat

SEQ ID NO: 837305 - DNA, 20 bp, mouse
ggccaggcagcggacccctt

SEQ ID NO: 837306 - DNA, 20 bp, mouse
gtcaggggcatagggctaaa

SEQ ID NO: 837307 - DNA, 20 bp, mouse
gctaaagggtaaagaaccaa

SEQ ID NO: 837308 - DNA, 20 bp, mouse
ggcgtcctgggagatgtagc

SEQ ID NO: 837309 - DNA, 20 bp, mouse
gtcccagatgaggcagggtc

SEQ ID NO: 837310 - DNA, 20 bp, mouse
gggctctcccagatgaggca

SEQ ID NO: 837311 - DNA, 20 bp, mouse
gccggcgtcctgctctacgg

SEQ ID NO: 837312 - DNA, 20 bp, mouse
gacttgaaagtctggcgtgg

SEQ ID NO: 837313 - DNA, 20 bp, mouse
ggtccaggctctcccagatg

SEQ ID NO: 837314 - DNA, 20 bp, mouse
ggtcctgctctacggtgggt

SEQ ID NO: 837315 - DNA, 20 bp, mouse
gacgcccagcgctatagtct

SEQ ID NO: 837316 - DNA, 20 bp, mouse
gcggacccccgcccagctca

SEQ ID NO: 837317 - DNA, 20 bp, mouse
ggggggtccggtcatgagaa

SEQ ID NO: 837318 - DNA, 20 bp, mouse
gagggtgggcgtggccaaaa

SEQ ID NO: 837319 - DNA, 20 bp, mouse
ggtccggtcatgagaagggt

SEQ ID NO: 837320 - DNA, 20 bp, mouse
ggggcgggggctgatggcga

SEQ ID NO: 837321 - DNA, 20 bp, mouse
gcggaaatactgtgaccagt

SEQ ID NO: 837322 - DNA, 20 bp, mouse
gtgcaggcaggtgggatcat

SEQ ID NO: 837323 - DNA, 20 bp, mouse
gggctgatggcgacggaagc

SEQ ID NO: 837324 - DNA, 20 bp, mouse
gcccagctcagggaacccac

SEQ ID NO: 837325 - DNA, 20 bp, mouse
gtcaaagaggcagtaggggc

SEQ ID NO: 837326 - DNA, 20 bp, mouse
ggaggaagaaggggtggtac

SEQ ID NO: 837327 - DNA, 20 bp, mouse
ggaaggaagtggaggatccg

SEQ ID NO: 837328 - DNA, 20 bp, mouse
gaaaacccggggcagatctt

SEQ ID NO: 837329 - DNA, 20 bp, mouse
gtaggcacctcccctagtaa

SEQ ID NO: 837330 - DNA, 20 bp, mouse
ggacctggagcctgcgaggg

SEQ ID NO: 837331 - DNA, 20 bp, mouse
gactaggggaggtgcctacg

SEQ ID NO: 837332 - DNA, 20 bp, mouse
gagtagaagactagtgtgaa

SEQ ID NO: 837333 - DNA, 20 bp, mouse
gagaccccaagctatcacca

SEQ ID NO: 837334 - DNA, 20 bp, mouse
gccagcctggagtcggtgac

SEQ ID NO: 837335 - DNA, 20 bp, mouse
gtgactggcggttcccacgt

SEQ ID NO: 837336 - DNA, 20 bp, mouse
gacaggaaatgtggtgatag

SEQ ID NO: 837337 - DNA, 20 bp, mouse
gacagagcgagttcacactg

SEQ ID NO: 837338 - DNA, 20 bp, mouse
gttaaatagttgtgaaacgt

SEQ ID NO: 837339 - DNA, 20 bp, mouse
gtcaggggaactcagatatg

SEQ ID NO: 837340 - DNA, 20 bp, mouse
gtacacggagggactcatgc

SEQ ID NO: 837341 - DNA, 20 bp, mouse
gcgtgtaagccagagtcaac

SEQ ID NO: 837342 - DNA, 20 bp, mouse
gtgtgcttttgtatgccaaa

SEQ ID NO: 837343 - DNA, 20 bp, mouse
gtggctaccgtgatggattg

SEQ ID NO: 837344 - DNA, 20 bp, mouse
gtactgataaagatatatgt

SEQ ID NO: 837345 - DNA, 20 bp, mouse
gtgggtaatagatgcctatc

SEQ ID NO: 837346 - DNA, 20 bp, mouse
gagactgaaacttttgctga

SEQ ID NO: 837347 - DNA, 20 bp, mouse
gatttttatatcaatgtatt

SEQ ID NO: 837348 - DNA, 20 bp, mouse
gtctgggtggagtgcagtgg

SEQ ID NO: 837349 - DNA, 20 bp, mouse
gcagacctggctgagagtct

SEQ ID NO: 837350 - DNA, 20 bp, mouse
ggcagtgtgagtgatctctg

SEQ ID NO: 837351 - DNA, 20 bp, mouse
ggagatgactctgggattac

SEQ ID NO: 837352 - DNA, 20 bp, mouse
gggacagtttgagatgactc

SEQ ID NO: 837353 - DNA, 20 bp, mouse
gctcgctttatttaattcat

SEQ ID NO: 837354 - DNA, 20 bp, mouse
gctttatttaattcataggt

SEQ ID NO: 837355 - DNA, 20 bp, mouse
gtctaatgatttcctattct

SEQ ID NO: 837356 - DNA, 20 bp, mouse
gagactgaaacttttgctga

SEQ ID NO: 837357 - DNA, 20 bp, mouse
gatttttatatcaatgtatt

SEQ ID NO: 837358 - DNA, 20 bp, mouse
gaccctgacaccacagcccc

SEQ ID NO: 837359 - DNA, 20 bp, mouse
gaagcaagtaaccagccccg

SEQ ID NO: 837360 - DNA, 20 bp, mouse
ggacaccacagccccggggc

SEQ ID NO: 837361 - DNA, 20 bp, mouse
gtctgggtggagtgcagtgg

SEQ ID NO: 837362 - DNA, 20 bp, mouse
gcagacctggctgagagtct

SEQ ID NO: 837363 - DNA, 20 bp, mouse
ggcagtgtgagtgatctctg

SEQ ID NO: 837364 - DNA, 20 bp, mouse
ggagatgactctgggattac

SEQ ID NO: 837365 - DNA, 20 bp, mouse
gggacagtttgagatgactc

SEQ ID NO: 837366 - DNA, 20 bp, mouse
ggaaaaaataaattgccctt

SEQ ID NO: 837367 - DNA, 20 bp, mouse
gtgcatacattttcaccaaa

SEQ ID NO: 837368 - DNA, 20 bp, mouse
gtgtgtgtgtgtggtttaga

SEQ ID NO: 837369 - DNA, 20 bp, mouse
gtggtttagagggaggtgga

SEQ ID NO: 837370 - DNA, 20 bp, mouse
ggacactaaggtgaatccac

SEQ ID NO: 837371 - DNA, 20 bp, mouse
gagaagatactgccatcctg

SEQ ID NO: 837372 - DNA, 20 bp, mouse
gttgatgtagcagtgaaact

SEQ ID NO: 837373 - DNA, 20 bp, mouse
gccagaggcactttctcata

SEQ ID NO: 837374 - DNA, 20 bp, mouse
gctaaggtgaatccacagga

SEQ ID NO: 837375 - DNA, 20 bp, mouse
gtctaattggatgaacagtt

SEQ ID NO: 837376 - DNA, 20 bp, mouse
gaagaactcagattggttca

SEQ ID NO: 837377 - DNA, 20 bp, mouse
gctgagttgagggtgcatgg

SEQ ID NO: 837378 - DNA, 20 bp, mouse
gccagcaacttcgctactga

SEQ ID NO: 837379 - DNA, 20 bp, mouse
gactcagattggttcaggga

SEQ ID NO: 837380 - DNA, 20 bp, mouse
gggactgagttgagggtgca

SEQ ID NO: 837381 - DNA, 20 bp, mouse
gatcatctaagaactcagat

SEQ ID NO: 837382 - DNA, 20 bp, mouse
gaaaaaaaaacccacagaag

SEQ ID NO: 837383 - DNA, 20 bp, mouse
gagtgtgttcatttcaatct

SEQ ID NO: 837384 - DNA, 20 bp, mouse
ggggccaggaccacttctgt

SEQ ID NO: 837385 - DNA, 20 bp, mouse
gtgttctgaagcttaagaaa

SEQ ID NO: 837386 - DNA, 20 bp, mouse
gtggtggaacacacggggat

SEQ ID NO: 837387 - DNA, 20 bp, mouse
ggtgccccatctctgaaact

SEQ ID NO: 837388 - DNA, 20 bp, mouse
gatgaccaagatgacatcca

SEQ ID NO: 837389 - DNA, 20 bp, mouse
gcaaacaggaagagggtacc

SEQ ID NO: 837390 - DNA, 20 bp, mouse
gtcatcttggtcatcagaga

SEQ ID NO: 837391 - DNA, 20 bp, mouse
gcggggatgggttctgaacc

SEQ ID NO: 837392 - DNA, 20 bp, mouse
gcatcagagagggcactatg

SEQ ID NO: 837393 - DNA, 20 bp, mouse
gttcatgagaccttagtccc

SEQ ID NO: 837394 - DNA, 20 bp, mouse
gaggaaagagtggggtgtct

SEQ ID NO: 837395 - DNA, 20 bp, mouse
gcccatctctgaaactagga

SEQ ID NO: 837396 - DNA, 20 bp, mouse
gggctagcagggctaggaag

SEQ ID NO: 837397 - DNA, 20 bp, mouse
gtggagcccgggggctagca

SEQ ID NO: 837398 - DNA, 20 bp, mouse
ggagcggcagtctctcactt

SEQ ID NO: 837399 - DNA, 20 bp, mouse
ggaaccagaagcgaagggaa

SEQ ID NO: 837400 - DNA, 20 bp, mouse
gggaggaaaaagcacaaatc

SEQ ID NO: 837401 - DNA, 20 bp, mouse
gaagggaacggagcggacat

SEQ ID NO: 837402 - DNA, 20 bp, mouse
ggcagattaagatcacagtt

SEQ ID NO: 837403 - DNA, 20 bp, mouse
gatcacagtttggagcccgg

SEQ ID NO: 837404 - DNA, 20 bp, mouse
gcctagccctgctagccccc

SEQ ID NO: 837405 - DNA, 20 bp, mouse
gcatcctccctattatgaat

SEQ ID NO: 837406 - DNA, 20 bp, mouse
gtatatcagagacactgcgg

SEQ ID NO: 837407 - DNA, 20 bp, mouse
gtctcaagccctaaagatac

SEQ ID NO: 837408 - DNA, 20 bp, mouse
gcacaagtactgcttggaaa

SEQ ID NO: 837409 - DNA, 20 bp, mouse
gtcctcccctagccaaataa

SEQ ID NO: 837410 - DNA, 20 bp, mouse
ggaagagtccaaggcagatg

SEQ ID NO: 837411 - DNA, 20 bp, mouse
gaataaatctgagctatcta

SEQ ID NO: 837412 - DNA, 20 bp, mouse
gatctttagggcttgagagt

SEQ ID NO: 837413 - DNA, 20 bp, mouse
gcagcactttctagatactc

SEQ ID NO: 837414 - DNA, 20 bp, mouse
gctagccaaataagggagag

SEQ ID NO: 837415 - DNA, 20 bp, mouse
gtagtcaagtgcacttatat

SEQ ID NO: 837416 - DNA, 20 bp, mouse
gatgaggtgtggccacctga

SEQ ID NO: 837417 - DNA, 20 bp, mouse
gtatatgggtgggcacccaa

SEQ ID NO: 837418 - DNA, 20 bp, mouse
gtagacactgagtctgtgtg

SEQ ID NO: 837419 - DNA, 20 bp, mouse
gtgctcagagttatatgggt

SEQ ID NO: 837420 - DNA, 20 bp, mouse
gaagtccaggctatgaggtg

SEQ ID NO: 837421 - DNA, 20 bp, mouse
ggggtgggcacccaagggcc

SEQ ID NO: 837422 - DNA, 20 bp, mouse
gagccaaagtccaggctatg

SEQ ID NO: 837423 - DNA, 20 bp, mouse
gactttgctcagagttatat

SEQ ID NO: 837424 - DNA, 20 bp, mouse
gggtgcaaaagttgtgtgac

SEQ ID NO: 837425 - DNA, 20 bp, mouse
gccttctggcattagagact

SEQ ID NO: 837426 - DNA, 20 bp, mouse
gcatcagtaaggaagttcag

SEQ ID NO: 837427 - DNA, 20 bp, mouse
gctgcgggctgacatcagta

SEQ ID NO: 837428 - DNA, 20 bp, mouse
gaggccattcctgggaggta

SEQ ID NO: 837429 - DNA, 20 bp, mouse
gggaggtaaggtactgtcac

SEQ ID NO: 837430 - DNA, 20 bp, mouse
gcagcccaggcaggaccgaa

SEQ ID NO: 837431 - DNA, 20 bp, mouse
gaccgaatggcaaggaactt

SEQ ID NO: 837432 - DNA, 20 bp, mouse
gatgtgaggccattcctggg

SEQ ID NO: 837433 - DNA, 20 bp, mouse
ggcctctgtctcaattactc

SEQ ID NO: 837434 - DNA, 20 bp, mouse
gaggatgtgaggccattcct

SEQ ID NO: 837435 - DNA, 20 bp, mouse
gaaaataattttcagagaag

SEQ ID NO: 837436 - DNA, 20 bp, mouse
gtaccctgacgctgtagcca

SEQ ID NO: 837437 - DNA, 20 bp, mouse
gtaggcgctgtgattcaagg

SEQ ID NO: 837438 - DNA, 20 bp, mouse
gcagagcctcatttgagggg

SEQ ID NO: 837439 - DNA, 20 bp, mouse
gaaggaggcttctacagtaa

SEQ ID NO: 837440 - DNA, 20 bp, mouse
gcccgcaaggctggcatggg

SEQ ID NO: 837441 - DNA, 20 bp, mouse
ggggtaggcgctgtgattca

SEQ ID NO: 837442 - DNA, 20 bp, mouse
gtatctggaccctggattgt

SEQ ID NO: 837443 - DNA, 20 bp, mouse
gacaccctggctacagcgtc

SEQ ID NO: 837444 - DNA, 20 bp, mouse
gggtcagctgctttcccgca

SEQ ID NO: 837445 - DNA, 20 bp, mouse
gtgagcaacagtcaggacta

SEQ ID NO: 837446 - DNA, 20 bp, mouse
gaagctgccttgggagacac

SEQ ID NO: 837447 - DNA, 20 bp, mouse
gttcccttggtgtttctcaa

SEQ ID NO: 837448 - DNA, 20 bp, mouse
ggcagtgagtggaacagtgt

SEQ ID NO: 837449 - DNA, 20 bp, mouse
gggagggtgtcacaaaaaat

SEQ ID NO: 837450 - DNA, 20 bp, mouse
gtgccttgggagacacagga

SEQ ID NO: 837451 - DNA, 20 bp, mouse
gcaacagattgtggcatcaa

SEQ ID NO: 837452 - DNA, 20 bp, mouse
ggcttggggaggacggtgtg

SEQ ID NO: 837453 - DNA, 20 bp, mouse
gacaatgttctggtatccag

SEQ ID NO: 837454 - DNA, 20 bp, mouse
gcgtcctccccaagccaagg

SEQ ID NO: 837455 - DNA, 20 bp, mouse
gtcccattgagaaacaccaa

SEQ ID NO: 837456 - DNA, 20 bp, mouse
gaaggccccgagagaccggt

SEQ ID NO: 837457 - DNA, 20 bp, mouse
ggagaccggtaggcaagtga

SEQ ID NO: 837458 - DNA, 20 bp, mouse
gggtctgataccccaccaaa

SEQ ID NO: 837459 - DNA, 20 bp, mouse
gtcagaaggccccgagagac

SEQ ID NO: 837460 - DNA, 20 bp, mouse
ggtcccctctccattccctt

SEQ ID NO: 837461 - DNA, 20 bp, mouse
ggcgctccagctatccatcg

SEQ ID NO: 837462 - DNA, 20 bp, mouse
gaccagagggcaggagaata

SEQ ID NO: 837463 - DNA, 20 bp, mouse
ggacccagcaaccagagggc

SEQ ID NO: 837464 - DNA, 20 bp, mouse
ggataccccaccaaagggaa

SEQ ID NO: 837465 - DNA, 20 bp, mouse
gacaggtccaggggtttcta

SEQ ID NO: 837466 - DNA, 20 bp, mouse
ggcccaggggccccaagaca

SEQ ID NO: 837467 - DNA, 20 bp, mouse
gtcagaacttcaggcaggtg

SEQ ID NO: 837468 - DNA, 20 bp, mouse
gggtcctccactcggggaac

SEQ ID NO: 837469 - DNA, 20 bp, mouse
ggctgctccaccctgtcttg

SEQ ID NO: 837470 - DNA, 20 bp, mouse
gcctccactcggggaactgg

SEQ ID NO: 837471 - DNA, 20 bp, mouse
gggaccagctgctgtgaatg

SEQ ID NO: 837472 - DNA, 20 bp, mouse
ggaactggaggagaggcttc

SEQ ID NO: 837473 - DNA, 20 bp, mouse
gtggagcctatcacaattgt

SEQ ID NO: 837474 - DNA, 20 bp, mouse
gaccctgtcttggggcccct

SEQ ID NO: 837475 - DNA, 20 bp, mouse
gagaaaactggatccatctg

SEQ ID NO: 837476 - DNA, 20 bp, mouse
gatgggacacggatgagcag

SEQ ID NO: 837477 - DNA, 20 bp, mouse
ggaggagtgtgattggtggg

SEQ ID NO: 837478 - DNA, 20 bp, mouse
ggggaagtggggctactggg

SEQ ID NO: 837479 - DNA, 20 bp, mouse
gaactgcagggtccatctcg

SEQ ID NO: 837480 - DNA, 20 bp, mouse
ggactctgggcacacctcta

SEQ ID NO: 837481 - DNA, 20 bp, mouse
ggtggttgacctaggtagat

SEQ ID NO: 837482 - DNA, 20 bp, mouse
ggaggtgtgcccagagtcct

SEQ ID NO: 837483 - DNA, 20 bp, mouse
gtccatctcgtggttgacct

SEQ ID NO: 837484 - DNA, 20 bp, mouse
gggaagtagccagtctggga

SEQ ID NO: 837485 - DNA, 20 bp, mouse
gcctaggtagataggttctg

SEQ ID NO: 837486 - DNA, 20 bp, mouse
ggccgagaggagcttaggaa

SEQ ID NO: 837487 - DNA, 20 bp, mouse
ggctggggagcggatccgga

SEQ ID NO: 837488 - DNA, 20 bp, mouse
gagcttaggaacggttgcta

SEQ ID NO: 837489 - DNA, 20 bp, mouse
ggggtgctggggagcggatc

SEQ ID NO: 837490 - DNA, 20 bp, mouse
gccatcgcatagagggaagg

SEQ ID NO: 837491 - DNA, 20 bp, mouse
ggccccctccccgagccctc

SEQ ID NO: 837492 - DNA, 20 bp, mouse
gcccggccgcagcccactca

SEQ ID NO: 837493 - DNA, 20 bp, mouse
gaaaaggccgagaggagctt

SEQ ID NO: 837494 - DNA, 20 bp, mouse
ggggtgggtgatgggtgaaa

SEQ ID NO: 837495 - DNA, 20 bp, mouse
gcagacaggcgggtaaaaga

SEQ ID NO: 837496 - DNA, 20 bp, mouse
ggggaggagcgtcagcacga

SEQ ID NO: 837497 - DNA, 20 bp, mouse
gggatcacagatatggatct

SEQ ID NO: 837498 - DNA, 20 bp, mouse
gcaaggggagactcatggaa

SEQ ID NO: 837499 - DNA, 20 bp, mouse
gatcctgctggctggtaaaa

SEQ ID NO: 837500 - DNA, 20 bp, mouse
gactcctgctggagttgaga

SEQ ID NO: 837501 - DNA, 20 bp, mouse
gatccaggccttcctaaaaa

SEQ ID NO: 837502 - DNA, 20 bp, mouse
gaaggcctttggggtgcttg

SEQ ID NO: 837503 - DNA, 20 bp, mouse
gcacagatatggatctagga

SEQ ID NO: 837504 - DNA, 20 bp, mouse
ggggggcaggggtacgtttg

SEQ ID NO: 837505 - DNA, 20 bp, mouse
gccgcccaaagctatgactc

SEQ ID NO: 837506 - DNA, 20 bp, mouse
gtggctgcaagctcatgagg

SEQ ID NO: 837507 - DNA, 20 bp, mouse
gggaggctgcaggacctgtg

SEQ ID NO: 837508 - DNA, 20 bp, mouse
gcgaaggaatgtgtcctcac

SEQ ID NO: 837509 - DNA, 20 bp, mouse
gctcctggttgcccaactgg

SEQ ID NO: 837510 - DNA, 20 bp, mouse
gggctgtgtcctctgattaa

SEQ ID NO: 837511 - DNA, 20 bp, mouse
ggtaggctctgactgcacac

SEQ ID NO: 837512 - DNA, 20 bp, mouse
gggaggaagtcagagtgtga

SEQ ID NO: 837513 - DNA, 20 bp, mouse
ggagcaccgtcacgagccga

SEQ ID NO: 837514 - DNA, 20 bp, mouse
gaaacatagggcgtgtgtcc

SEQ ID NO: 837515 - DNA, 20 bp, mouse
gagttgggcaaccaggagac

SEQ ID NO: 837516 - DNA, 20 bp, mouse
gcagttctgtcccacagctc

SEQ ID NO: 837517 - DNA, 20 bp, mouse
gggggtggatgcggggtgat

SEQ ID NO: 837518 - DNA, 20 bp, mouse
ggtgatcatcagggcaagaa

SEQ ID NO: 837519 - DNA, 20 bp, mouse
gacagctgcttgggcgggag

SEQ ID NO: 837520 - DNA, 20 bp, mouse
gagactgaggcttgagcgga

SEQ ID NO: 837521 - DNA, 20 bp, mouse
gtgtgggacagaactgcgca

SEQ ID NO: 837522 - DNA, 20 bp, mouse
gcccctccctccgtgcataa

SEQ ID NO: 837523 - DNA, 20 bp, mouse
gcaaccttataggggggcgg

SEQ ID NO: 837524 - DNA, 20 bp, mouse
gtggactgcgcaaacacaag

SEQ ID NO: 837525 - DNA, 20 bp, mouse
ggatcccagcaacagtccgg

SEQ ID NO: 837526 - DNA, 20 bp, mouse
gtggagtgaacagggaatta

SEQ ID NO: 837527 - DNA, 20 bp, mouse
gacaaagaggcgctgggtga

SEQ ID NO: 837528 - DNA, 20 bp, mouse
gaaaaacagtggagtgaaca

SEQ ID NO: 837529 - DNA, 20 bp, mouse
gaacaggaacactttggcaa

SEQ ID NO: 837530 - DNA, 20 bp, mouse
gagtgaacagggaattaggg

SEQ ID NO: 837531 - DNA, 20 bp, mouse
gatcccggacaaagaggcgc

SEQ ID NO: 837532 - DNA, 20 bp, mouse
ggacctcagccaagaggcag

SEQ ID NO: 837533 - DNA, 20 bp, mouse
gtactcaggcagacagggag

SEQ ID NO: 837534 - DNA, 20 bp, mouse
gagttctcacttaactactc

SEQ ID NO: 837535 - DNA, 20 bp, mouse
gaccaggagagaagttattc

SEQ ID NO: 837536 - DNA, 20 bp, mouse
ggggcgcaggccgaatgcag

SEQ ID NO: 837537 - DNA, 20 bp, mouse
gcctgtgaggtcagcgggga

SEQ ID NO: 837538 - DNA, 20 bp, mouse
gccgaatgcaggggcgctga

SEQ ID NO: 837539 - DNA, 20 bp, mouse
gagggagggagagacgtccc

SEQ ID NO: 837540 - DNA, 20 bp, mouse
gaggcgcggctggcgcaggt

SEQ ID NO: 837541 - DNA, 20 bp, mouse
gactaagagaacatctgact

SEQ ID NO: 837542 - DNA, 20 bp, mouse
gcgctcgctcggcccccacc

SEQ ID NO: 837543 - DNA, 20 bp, mouse
gtcccgggaatagttcgcga

SEQ ID NO: 837544 - DNA, 20 bp, mouse
gacatctgactagggaacaa

SEQ ID NO: 837545 - DNA, 20 bp, mouse
ggggggacccgcccgctttc

SEQ ID NO: 837546 - DNA, 20 bp, mouse
ggggctaaggagtcggaaga

SEQ ID NO: 837547 - DNA, 20 bp, mouse
gcggaagaggggtgactgcg

SEQ ID NO: 837548 - DNA, 20 bp, mouse
gggctccagtggtccctctg

SEQ ID NO: 837549 - DNA, 20 bp, mouse
gctctggggaatccgcagta

SEQ ID NO: 837550 - DNA, 20 bp, mouse
gggaatccgcagtagggcta

SEQ ID NO: 837551 - DNA, 20 bp, mouse
gcgactccttagccctactg

SEQ ID NO: 837552 - DNA, 20 bp, mouse
gcaaccccctctgtggctgt

SEQ ID NO: 837553 - DNA, 20 bp, mouse
ggattccccagagggaccac

SEQ ID NO: 837554 - DNA, 20 bp, mouse
gtgtgtgtgtacacgggctc

SEQ ID NO: 837555 - DNA, 20 bp, mouse
gaatgcagctggagtaccct

SEQ ID NO: 837556 - DNA, 20 bp, mouse
gtggaagcagccgagcttgt

SEQ ID NO: 837557 - DNA, 20 bp, mouse
ggagagagagctctcattaa

SEQ ID NO: 837558 - DNA, 20 bp, mouse
ggctgacatagtgctcagtg

SEQ ID NO: 837559 - DNA, 20 bp, mouse
gtagtggagaaacagtacaa

SEQ ID NO: 837560 - DNA, 20 bp, mouse
gctcattaagggacgatcta

SEQ ID NO: 837561 - DNA, 20 bp, mouse
ggcatctttacctacaagct

SEQ ID NO: 837562 - DNA, 20 bp, mouse
ggacttgaagacttggagca

SEQ ID NO: 837563 - DNA, 20 bp, mouse
gagcagatttactggtttag

SEQ ID NO: 837564 - DNA, 20 bp, mouse
gatctatggtttgacagcct

SEQ ID NO: 837565 - DNA, 20 bp, mouse
gtttttacttcttgcttgat

SEQ ID NO: 837566 - DNA, 20 bp, mouse
ggggcagtctatagggcatg

SEQ ID NO: 837567 - DNA, 20 bp, mouse
gggacagggctcagatagga

SEQ ID NO: 837568 - DNA, 20 bp, mouse
gggcatcagatggcattccc

SEQ ID NO: 837569 - DNA, 20 bp, mouse
gccctgtggaccctccactg

SEQ ID NO: 837570 - DNA, 20 bp, mouse
gtgacaacttacttatagat

SEQ ID NO: 837571 - DNA, 20 bp, mouse
ggctgggacagggctcagat

SEQ ID NO: 837572 - DNA, 20 bp, mouse
gagtcagcgtagaaatcagg

SEQ ID NO: 837573 - DNA, 20 bp, mouse
ggctctagagtcagggctaa

SEQ ID NO: 837574 - DNA, 20 bp, mouse
ggtgtgtgtacctagtgcct

SEQ ID NO: 837575 - DNA, 20 bp, mouse
ggaacagcaggcttcgagga

SEQ ID NO: 837576 - DNA, 20 bp, mouse
gctaccgtctgtccctacgg

SEQ ID NO: 837577 - DNA, 20 bp, mouse
ggggacgagacgtggagcct

SEQ ID NO: 837578 - DNA, 20 bp, mouse
ggggaaaggtccaggcggcg

SEQ ID NO: 837579 - DNA, 20 bp, mouse
gccacagggaaaggtccagg

SEQ ID NO: 837580 - DNA, 20 bp, mouse
gcacgcgaccgctgccctgg

SEQ ID NO: 837581 - DNA, 20 bp, mouse
gaaagcgaatccacagggaa

SEQ ID NO: 837582 - DNA, 20 bp, mouse
ggcccgaaatcgcacactcg

SEQ ID NO: 837583 - DNA, 20 bp, mouse
gtgcacgccgtggacactga

SEQ ID NO: 837584 - DNA, 20 bp, mouse
ggactggcgctggtgaactt

SEQ ID NO: 837585 - DNA, 20 bp, mouse
gccgagaagcaaaagaaatg

SEQ ID NO: 837586 - DNA, 20 bp, mouse
gtcgcccggcttgcagtcac

SEQ ID NO: 837587 - DNA, 20 bp, mouse
gctgcccagcccaacccggg

SEQ ID NO: 837588 - DNA, 20 bp, mouse
gttgcagtcaccggagcgga

SEQ ID NO: 837589 - DNA, 20 bp, mouse
ggaggtggctgcgacgactc

SEQ ID NO: 837590 - DNA, 20 bp, mouse
ggcgcaggtgggaacgtcct

SEQ ID NO: 837591 - DNA, 20 bp, mouse
gcgcacacgccccccgggtt

SEQ ID NO: 837592 - DNA, 20 bp, mouse
gcgcgcgcccaaggcgtccc

SEQ ID NO: 837593 - DNA, 20 bp, mouse
ggcaagccgggcgacggggc

SEQ ID NO: 837594 - DNA, 20 bp, mouse
gcgctccggtgactgcaagc

SEQ ID NO: 837595 - DNA, 20 bp, mouse
ggccgggttgtgcaatgagg

SEQ ID NO: 837596 - DNA, 20 bp, mouse
gagggcggggccggcgaaga

SEQ ID NO: 837597 - DNA, 20 bp, mouse
ggccgcgcgcgcactggcag

SEQ ID NO: 837598 - DNA, 20 bp, mouse
ggggctccgggctcaatgac

SEQ ID NO: 837599 - DNA, 20 bp, mouse
ggggctctgtggaaatgtgt

SEQ ID NO: 837600 - DNA, 20 bp, mouse
ggaagagggcgggggctctg

SEQ ID NO: 837601 - DNA, 20 bp, mouse
gcgaggctggcgcccccagt

SEQ ID NO: 837602 - DNA, 20 bp, mouse
gggccggggcgtgggtaggg

SEQ ID NO: 837603 - DNA, 20 bp, mouse
gcccggagcccatcaatcag

SEQ ID NO: 837604 - DNA, 20 bp, mouse
gggctcaatgacaggggccg

SEQ ID NO: 837605 - DNA, 20 bp, mouse
gcagcggcgccgctgattga

SEQ ID NO: 837606 - DNA, 20 bp, mouse
gcgtgtggccccgaaggtga

SEQ ID NO: 837607 - DNA, 20 bp, mouse
gctacaatacggagagtcgg

SEQ ID NO: 837608 - DNA, 20 bp, mouse
gtgggggcgtgtggccccga

SEQ ID NO: 837609 - DNA, 20 bp, mouse
gagctccgccctcaccttcg

SEQ ID NO: 837610 - DNA, 20 bp, mouse
gcacccgctacccggtagtc

SEQ ID NO: 837611 - DNA, 20 bp, mouse
gtaccgggtagcgggtggag

SEQ ID NO: 837612 - DNA, 20 bp, mouse
gtggctccgagtgctacttc

SEQ ID NO: 837613 - DNA, 20 bp, mouse
ggctcactcggcgacatggg

SEQ ID NO: 837614 - DNA, 20 bp, mouse
ggtggccccgaaggtgaggg

SEQ ID NO: 837615 - DNA, 20 bp, mouse
ggacatgggcgggtcacaga

SEQ ID NO: 837616 - DNA, 20 bp, mouse
ggggaggaggaaacactaag

SEQ ID NO: 837617 - DNA, 20 bp, mouse
ggcaggacagaccccggctg

SEQ ID NO: 837618 - DNA, 20 bp, mouse
gggggcgggggtggattacc

SEQ ID NO: 837619 - DNA, 20 bp, mouse
gtccgcctgcatcccccggg

SEQ ID NO: 837620 - DNA, 20 bp, mouse
gtaaaaacagctgtacgggt

SEQ ID NO: 837621 - DNA, 20 bp, mouse
gcgtctggtcagccctagcc

SEQ ID NO: 837622 - DNA, 20 bp, mouse
gtcacttggcgtccgggcta

SEQ ID NO: 837623 - DNA, 20 bp, mouse
gtctgccccccgggggatgc

SEQ ID NO: 837624 - DNA, 20 bp, mouse
gggattaaaaacagctgtac

SEQ ID NO: 837625 - DNA, 20 bp, mouse
gagaagagtaggtaaaatgt

SEQ ID NO: 837626 - DNA, 20 bp, mouse
ggagtgtggggactcagata

SEQ ID NO: 837627 - DNA, 20 bp, mouse
gtagtggccaggggagtgtg

SEQ ID NO: 837628 - DNA, 20 bp, mouse
gagtacaaggctagtggcca

SEQ ID NO: 837629 - DNA, 20 bp, mouse
gctggggtgtgcacagcaca

SEQ ID NO: 837630 - DNA, 20 bp, mouse
gggaggtatcagccagtaca

SEQ ID NO: 837631 - DNA, 20 bp, mouse
gtaaaagagggccgagagaa

SEQ ID NO: 837632 - DNA, 20 bp, mouse
gaactgtggtgatgcctcca

SEQ ID NO: 837633 - DNA, 20 bp, mouse
gctgagtccccacactcccc

SEQ ID NO: 837634 - DNA, 20 bp, mouse
gtgcacagcacaaggaactg

SEQ ID NO: 837635 - DNA, 20 bp, mouse
gctgtctccagggagattgg

SEQ ID NO: 837636 - DNA, 20 bp, mouse
gccgctgtgtatcggggctc

SEQ ID NO: 837637 - DNA, 20 bp, mouse
gggtgcggggacaccacctg

SEQ ID NO: 837638 - DNA, 20 bp, mouse
gggttggccgctgtgtatcg

SEQ ID NO: 837639 - DNA, 20 bp, mouse
gcggccaacccaagaacaaa

SEQ ID NO: 837640 - DNA, 20 bp, mouse
gtaagctctcagacttccgc

SEQ ID NO: 837641 - DNA, 20 bp, mouse
gttgcagcatccggatcttg

SEQ ID NO: 837642 - DNA, 20 bp, mouse
gtcgatcccggcatccaccc

SEQ ID NO: 837643 - DNA, 20 bp, mouse
gttagaacccgtttgttctt

SEQ ID NO: 837644 - DNA, 20 bp, mouse
gaagtctgagagcttagtgc

SEQ ID NO: 837645 - DNA, 20 bp, mouse
gaacccgtttgttcttgggt

SEQ ID NO: 837646 - DNA, 20 bp, mouse
gccagccaatgctgatatga

SEQ ID NO: 837647 - DNA, 20 bp, mouse
gtcagtcagtggggttctgc

SEQ ID NO: 837648 - DNA, 20 bp, mouse
ggggtaacttcctcagtcag

SEQ ID NO: 837649 - DNA, 20 bp, mouse
gccggctaaaatctagagaa

SEQ ID NO: 837650 - DNA, 20 bp, mouse
gcaagcatgaagcactggga

SEQ ID NO: 837651 - DNA, 20 bp, mouse
ggaaaggaaagtttgagctc

SEQ ID NO: 837652 - DNA, 20 bp, mouse
gccagtgcttcatgcttgat

SEQ ID NO: 837653 - DNA, 20 bp, mouse
ggggctcaccagctgcccca

SEQ ID NO: 837654 - DNA, 20 bp, mouse
gtaatctggaggagaccatg

SEQ ID NO: 837655 - DNA, 20 bp, mouse
gagcactaacggattagaag

SEQ ID NO: 837656 - DNA, 20 bp, mouse
gtaatctggtggagactatt

SEQ ID NO: 837657 - DNA, 20 bp, mouse
ggcagggcccacactgactg

SEQ ID NO: 837658 - DNA, 20 bp, mouse
gtaagtaagacagaccgcag

SEQ ID NO: 837659 - DNA, 20 bp, mouse
gagcagtaccggaattagaa

SEQ ID NO: 837660 - DNA, 20 bp, mouse
ggtggagactattgggcagc

SEQ ID NO: 837661 - DNA, 20 bp, mouse
gatgactaggacaagttaca

SEQ ID NO: 837662 - DNA, 20 bp, mouse
gccgcaggggccaccacaca

SEQ ID NO: 837663 - DNA, 20 bp, mouse
gtatagtgactcagcagtac

SEQ ID NO: 837664 - DNA, 20 bp, mouse
gagtgcttgcctatcaagca

SEQ ID NO: 837665 - DNA, 20 bp, mouse
gtaacttcctcagtcagtgt

SEQ ID NO: 837666 - DNA, 20 bp, mouse
gcaaagtggtgtgaagggtt

SEQ ID NO: 837667 - DNA, 20 bp, mouse
gcgggacagcgggaagcaga

SEQ ID NO: 837668 - DNA, 20 bp, mouse
ggacgcccacgcgccgagtt

SEQ ID NO: 837669 - DNA, 20 bp, mouse
ggtaggcaaagtggtgtgaa

SEQ ID NO: 837670 - DNA, 20 bp, mouse
gagcctctggataagtgctc

SEQ ID NO: 837671 - DNA, 20 bp, mouse
gcaccagagcacttatccag

SEQ ID NO: 837672 - DNA, 20 bp, mouse
gtcctgaaaagtaggcaaag

SEQ ID NO: 837673 - DNA, 20 bp, mouse
gcagcgggctcggcgatctc

SEQ ID NO: 837674 - DNA, 20 bp, mouse
gagaggctgggcgacctagg

SEQ ID NO: 837675 - DNA, 20 bp, mouse
ggtgcgcaggcgcgggacag

SEQ ID NO: 837676 - DNA, 20 bp, mouse
gtcccagtggcaaactggag

SEQ ID NO: 837677 - DNA, 20 bp, mouse
gcgggcgacccagctcccag

SEQ ID NO: 837678 - DNA, 20 bp, mouse
gtgcggaggtgcgtagtagg

SEQ ID NO: 837679 - DNA, 20 bp, mouse
gaactgcggaggtgcgtagt

SEQ ID NO: 837680 - DNA, 20 bp, mouse
gcactgatgggctcactgga

SEQ ID NO: 837681 - DNA, 20 bp, mouse
ggtggtgtggcctgcccaga

SEQ ID NO: 837682 - DNA, 20 bp, mouse
ggtcactatagataggaacg

SEQ ID NO: 837683 - DNA, 20 bp, mouse
gggaggaggtcactatagat

SEQ ID NO: 837684 - DNA, 20 bp, mouse
ggtgccgcggatccagcact

SEQ ID NO: 837685 - DNA, 20 bp, mouse
gcccgcttgttgatgatgtt

SEQ ID NO: 837686 - DNA, 20 bp, mouse
gccaagggaccgaaggcgac

SEQ ID NO: 837687 - DNA, 20 bp, mouse
gactacccagcgtttcccag

SEQ ID NO: 837688 - DNA, 20 bp, mouse
gcctgcccctgggaaacgct

SEQ ID NO: 837689 - DNA, 20 bp, mouse
ggcgacaggagtggagagct

SEQ ID NO: 837690 - DNA, 20 bp, mouse
gacagaagcaaaggaatcgg

SEQ ID NO: 837691 - DNA, 20 bp, mouse
gtgcccagcgtgacaggaag

SEQ ID NO: 837692 - DNA, 20 bp, mouse
gcaggtgagagccatagttc

SEQ ID NO: 837693 - DNA, 20 bp, mouse
gtccccacccaagggaccga

SEQ ID NO: 837694 - DNA, 20 bp, mouse
ggagccgcttcctgtcacgc

SEQ ID NO: 837695 - DNA, 20 bp, mouse
gcggaggctgaaagaaaggc

SEQ ID NO: 837696 - DNA, 20 bp, mouse
gtaactgagcttcctcggga

SEQ ID NO: 837697 - DNA, 20 bp, mouse
gggagaccacgtgtgcctgt

SEQ ID NO: 837698 - DNA, 20 bp, mouse
gtggctactagccaatctgg

SEQ ID NO: 837699 - DNA, 20 bp, mouse
gggacgaggctcctccagat

SEQ ID NO: 837700 - DNA, 20 bp, mouse
ggttctgagccttgtcactg

SEQ ID NO: 837701 - DNA, 20 bp, mouse
gtgagccttgtcactgtggc

SEQ ID NO: 837702 - DNA, 20 bp, mouse
ggaagctcagttactcagac

SEQ ID NO: 837703 - DNA, 20 bp, mouse
gggaccgctcaaagccgcag

SEQ ID NO: 837704 - DNA, 20 bp, mouse
gcagttactcagacaggacg

SEQ ID NO: 837705 - DNA, 20 bp, mouse
ggaggcttacaatagagctc

SEQ ID NO: 837706 - DNA, 20 bp, mouse
gcccaagaaaggctccaaaa

SEQ ID NO: 837707 - DNA, 20 bp, mouse
gctagactgcaccttcctat

SEQ ID NO: 837708 - DNA, 20 bp, mouse
gaggcatatgcaaattagga

SEQ ID NO: 837709 - DNA, 20 bp, mouse
gaaccaatcagaaaagaacg

SEQ ID NO: 837710 - DNA, 20 bp, mouse
gataatgtctagttgtacta

SEQ ID NO: 837711 - DNA, 20 bp, mouse
gaagaaaggctccaaaaagg

SEQ ID NO: 837712 - DNA, 20 bp, mouse
gttgggggctggagctgatt

SEQ ID NO: 837713 - DNA, 20 bp, mouse
gcaagctcttatatatgatc

SEQ ID NO: 837714 - DNA, 20 bp, mouse
ggagctgatttggatggatc

SEQ ID NO: 837715 - DNA, 20 bp, mouse
gatgccttgcattcaaatga

SEQ ID NO: 837716 - DNA, 20 bp, mouse
gaaggagcaagcatcgctgg

SEQ ID NO: 837717 - DNA, 20 bp, mouse
gcataaggagcaagcatcgc

SEQ ID NO: 837718 - DNA, 20 bp, mouse
gctggcggtgcagacaaaac

SEQ ID NO: 837719 - DNA, 20 bp, mouse
gccggtgcaaggctgccgcc

SEQ ID NO: 837720 - DNA, 20 bp, mouse
gcgactgcaggattaacccc

SEQ ID NO: 837721 - DNA, 20 bp, mouse
ggcagtcggggatttaggga

SEQ ID NO: 837722 - DNA, 20 bp, mouse
gctgcaaagagattcgcggg

SEQ ID NO: 837723 - DNA, 20 bp, mouse
gcaaaactggtacccaccca

SEQ ID NO: 837724 - DNA, 20 bp, mouse
gttgctccttatgcctcctg

SEQ ID NO: 837725 - DNA, 20 bp, mouse
gcgagctgcaaagagattcg

SEQ ID NO: 837726 - DNA, 20 bp, mouse
gaacgcccggcggtggaggc

SEQ ID NO: 837727 - DNA, 20 bp, mouse
gaccgaacgcccggcggtgg

SEQ ID NO: 837728 - DNA, 20 bp, mouse
ggaagtgacttcagctgtac

SEQ ID NO: 837729 - DNA, 20 bp, mouse
ggcagcctgcctccaccgcc

SEQ ID NO: 837730 - DNA, 20 bp, mouse
ggggacagagcgtgctttcg

SEQ ID NO: 837731 - DNA, 20 bp, mouse
gttcaataccgaacgcccgg

SEQ ID NO: 837732 - DNA, 20 bp, mouse
gaataccgaacgcccggcgg

SEQ ID NO: 837733 - DNA, 20 bp, mouse
ggatacagtcagcgctgaaa

SEQ ID NO: 837734 - DNA, 20 bp, mouse
gcactgctgaccgtgacaag

SEQ ID NO: 837735 - DNA, 20 bp, mouse
gcgtgctttcgtggggtggg

SEQ ID NO: 837736 - DNA, 20 bp, mouse
gtagagagacccaggaggac

SEQ ID NO: 837737 - DNA, 20 bp, mouse
gggtgcaagaaactgactcc

SEQ ID NO: 837738 - DNA, 20 bp, mouse
ggaaactgactcctggccac

SEQ ID NO: 837739 - DNA, 20 bp, mouse
gtgagagaagaggtctgaat

SEQ ID NO: 837740 - DNA, 20 bp, mouse
ggcggaggctgggcggagac

SEQ ID NO: 837741 - DNA, 20 bp, mouse
ggggggccttagagagaccc

SEQ ID NO: 837742 - DNA, 20 bp, mouse
gggaagctatccatccctgt

SEQ ID NO: 837743 - DNA, 20 bp, mouse
ggtggcgggatcagtcttgg

SEQ ID NO: 837744 - DNA, 20 bp, mouse
gactcagtacctgtcctcct

SEQ ID NO: 837745 - DNA, 20 bp, mouse
gtgaagggagttaagactta

SEQ ID NO: 837746 - DNA, 20 bp, mouse
gccgtacagccaatgactga

SEQ ID NO: 837747 - DNA, 20 bp, mouse
gggggagggcgctactgtca

SEQ ID NO: 837748 - DNA, 20 bp, mouse
gaacccctcctctcagtaaa

SEQ ID NO: 837749 - DNA, 20 bp, mouse
ggcatctgcgagtaatggag

SEQ ID NO: 837750 - DNA, 20 bp, mouse
gcacgcatgcgcaggataga

SEQ ID NO: 837751 - DNA, 20 bp, mouse
gtgaaagcatctgcgagtaa

SEQ ID NO: 837752 - DNA, 20 bp, mouse
gtgcgccgaggcttctgggt

SEQ ID NO: 837753 - DNA, 20 bp, mouse
gatgactgacgggagagaaa

SEQ ID NO: 837754 - DNA, 20 bp, mouse
ggccgccctcacgcatgcgc

SEQ ID NO: 837755 - DNA, 20 bp, mouse
ggcagtgtacgcggggcagg

SEQ ID NO: 837756 - DNA, 20 bp, mouse
ggggtctgcagaagcccgcg

SEQ ID NO: 837757 - DNA, 20 bp, mouse
ggaagcccgcgaggctcgga

SEQ ID NO: 837758 - DNA, 20 bp, mouse
gcccgcgggaggttgggagt

SEQ ID NO: 837759 - DNA, 20 bp, mouse
gggggccgtccgagcctcgc

SEQ ID NO: 837760 - DNA, 20 bp, mouse
gaccgccgcgcctgcccagg

SEQ ID NO: 837761 - DNA, 20 bp, mouse
gcggccgcggtcctcgcgtc

SEQ ID NO: 837762 - DNA, 20 bp, mouse
ggggcaggcgcggcggtcat

SEQ ID NO: 837763 - DNA, 20 bp, mouse
ggggcccgcggtggtccaag

SEQ ID NO: 837764 - DNA, 20 bp, mouse
gtccaaggggcccgagagaa

SEQ ID NO: 837765 - DNA, 20 bp, mouse
gaggcgcggcggtcattgga

SEQ ID NO: 837766 - DNA, 20 bp, mouse
gaggccccgaccaggagggt

SEQ ID NO: 837767 - DNA, 20 bp, mouse
gcgagcgacgcacgacccaa

SEQ ID NO: 837768 - DNA, 20 bp, mouse
gctaccaggtgcagtttcag

SEQ ID NO: 837769 - DNA, 20 bp, mouse
gcgtgcgtcgctcgggtccg

SEQ ID NO: 837770 - DNA, 20 bp, mouse
ggggcttcaggaagtcacgt

SEQ ID NO: 837771 - DNA, 20 bp, mouse
gctgcactgtgctaggacgt

SEQ ID NO: 837772 - DNA, 20 bp, mouse
ggacgtaggccccgaccagg

SEQ ID NO: 837773 - DNA, 20 bp, mouse
gcgctcgggtccgcggggtg

SEQ ID NO: 837774 - DNA, 20 bp, mouse
gtgcagatgaattgtcgcag

SEQ ID NO: 837775 - DNA, 20 bp, mouse
gtgatgctctccacaccccg

SEQ ID NO: 837776 - DNA, 20 bp, mouse
gggaagcggccagtgcgtca

SEQ ID NO: 837777 - DNA, 20 bp, mouse
gcccggccgcttcacctctt

SEQ ID NO: 837778 - DNA, 20 bp, mouse
gcgaggcctcgtgtaggtta

SEQ ID NO: 837779 - DNA, 20 bp, mouse
ggatcactgggcaaatcccc

SEQ ID NO: 837780 - DNA, 20 bp, mouse
gggtcccagagaaatctcgg

SEQ ID NO: 837781 - DNA, 20 bp, mouse
gccccaggcagcggccaaag

SEQ ID NO: 837782 - DNA, 20 bp, mouse
ggccaaagaggtgaagcggc

SEQ ID NO: 837783 - DNA, 20 bp, mouse
gggggtctcgaaagctatgg

SEQ ID NO: 837784 - DNA, 20 bp, mouse
gagcggccaaagaggtgaag

SEQ ID NO: 837785 - DNA, 20 bp, mouse
gaccgcagggaatcagaaat

SEQ ID NO: 837786 - DNA, 20 bp, mouse
gacagccacgaccgactccc

SEQ ID NO: 837787 - DNA, 20 bp, mouse
gcggccgcgcagactcctca

SEQ ID NO: 837788 - DNA, 20 bp, mouse
gccagcccgggagtcggtcg

SEQ ID NO: 837789 - DNA, 20 bp, mouse
gtgtcccctggcagtggcgt

SEQ ID NO: 837790 - DNA, 20 bp, mouse
gcggccctgaggagtctgcg

SEQ ID NO: 837791 - DNA, 20 bp, mouse
gtgacccgacgccactgcca

SEQ ID NO: 837792 - DNA, 20 bp, mouse
gctctctcggggcgggaaag

SEQ ID NO: 837793 - DNA, 20 bp, mouse
gaggcctgggccccggagcc

SEQ ID NO: 837794 - DNA, 20 bp, mouse
gcaacgtggccgcgtcggaa

SEQ ID NO: 837795 - DNA, 20 bp, mouse
gggtccccggcacccagccc

SEQ ID NO: 837796 - DNA, 20 bp, mouse
gcccaccgcacggtgcaccc

SEQ ID NO: 837797 - DNA, 20 bp, mouse
gaagaggggcgggacaatac

SEQ ID NO: 837798 - DNA, 20 bp, mouse
gtgcaccgtgcggtgggcat

SEQ ID NO: 837799 - DNA, 20 bp, mouse
ggggcgggacaatacagggt

SEQ ID NO: 837800 - DNA, 20 bp, mouse
ggcggcagcgagtggaaggg

SEQ ID NO: 837801 - DNA, 20 bp, mouse
gaggggcggcagcgagtgga

SEQ ID NO: 837802 - DNA, 20 bp, mouse
gcctgcgcgctcaagcacgc

SEQ ID NO: 837803 - DNA, 20 bp, mouse
gctagaggggcggcagcgag

SEQ ID NO: 837804 - DNA, 20 bp, mouse
ggcagcctggcctatagtcg

SEQ ID NO: 837805 - DNA, 20 bp, mouse
gggcgtggcgacgtctgcag

SEQ ID NO: 837806 - DNA, 20 bp, mouse
gaggagcaacctgacaaaac

SEQ ID NO: 837807 - DNA, 20 bp, mouse
gcagcctaacaggttgtcag

SEQ ID NO: 837808 - DNA, 20 bp, mouse
gcccctgggggcagaaggtg

SEQ ID NO: 837809 - DNA, 20 bp, mouse
gtggtgggaagtaataaaac

SEQ ID NO: 837810 - DNA, 20 bp, mouse
gtaaaatcccgggctgggga

SEQ ID NO: 837811 - DNA, 20 bp, mouse
gagcctctgtccacacaggt

SEQ ID NO: 837812 - DNA, 20 bp, mouse
gaaaacgggccgagagagac

SEQ ID NO: 837813 - DNA, 20 bp, mouse
gctgccccgcctgtctctct

SEQ ID NO: 837814 - DNA, 20 bp, mouse
gctaacaggttgtcagtggt

SEQ ID NO: 837815 - DNA, 20 bp, mouse
ggcagagtggttaattacct

SEQ ID NO: 837816 - DNA, 20 bp, mouse
gggagagccaagagccgcaa

SEQ ID NO: 837817 - DNA, 20 bp, mouse
gtcacgaggcctaagggcga

SEQ ID NO: 837818 - DNA, 20 bp, mouse
gccgccccggcccctccctc

SEQ ID NO: 837819 - DNA, 20 bp, mouse
gccaagagccgcaagggcgg

SEQ ID NO: 837820 - DNA, 20 bp, mouse
gcgggcgtggtctgagaggt

SEQ ID NO: 837821 - DNA, 20 bp, mouse
gtggctctccctctgcggtg

SEQ ID NO: 837822 - DNA, 20 bp, mouse
gcggggctgcggaccggtcg

SEQ ID NO: 837823 - DNA, 20 bp, mouse
gtcgggggagggggcgactc

SEQ ID NO: 837824 - DNA, 20 bp, mouse
gtggggcgggccttcggctc

SEQ ID NO: 837825 - DNA, 20 bp, mouse
gaggcagcaggcgaggatcc

SEQ ID NO: 837826 - DNA, 20 bp, mouse
gacagggtcaggaatttttt

SEQ ID NO: 837827 - DNA, 20 bp, mouse
gaaacacctcagtaccctca

SEQ ID NO: 837828 - DNA, 20 bp, mouse
ggacagaaagtgtctctcta

SEQ ID NO: 837829 - DNA, 20 bp, mouse
gggtggcaggtgtgacctaa

SEQ ID NO: 837830 - DNA, 20 bp, mouse
gtcctgaccctgtgtaaatc

SEQ ID NO: 837831 - DNA, 20 bp, mouse
gactactctctctgccgtga

SEQ ID NO: 837832 - DNA, 20 bp, mouse
ggtctctctaaggtcggagc

SEQ ID NO: 837833 - DNA, 20 bp, mouse
gttctttccagatttacaca

SEQ ID NO: 837834 - DNA, 20 bp, mouse
gctctgccgtgagggtactg

SEQ ID NO: 837835 - DNA, 20 bp, mouse
gaggagttatttgcagaacc

SEQ ID NO: 837836 - DNA, 20 bp, mouse
gtgagaatgtctcaagttac

SEQ ID NO: 837837 - DNA, 20 bp, mouse
ggagacattctcagagctac

SEQ ID NO: 837838 - DNA, 20 bp, mouse
gtgggttttgccctggtggc

SEQ ID NO: 837839 - DNA, 20 bp, mouse
gtaccaaactaccaaccaac

SEQ ID NO: 837840 - DNA, 20 bp, mouse
gtgcctgggttttgccctgg

SEQ ID NO: 837841 - DNA, 20 bp, mouse
gaagttcagactttaaaggt

SEQ ID NO: 837842 - DNA, 20 bp, mouse
gctgcacctgagctcctgcc

SEQ ID NO: 837843 - DNA, 20 bp, mouse
gagtccagctccaacctcag

SEQ ID NO: 837844 - DNA, 20 bp, mouse
gaaaacccaggcaggagctc

SEQ ID NO: 837845 - DNA, 20 bp, mouse
gcaggagaagcccatgggga

SEQ ID NO: 837846 - DNA, 20 bp, mouse
gtctaaagtgctctactctt

SEQ ID NO: 837847 - DNA, 20 bp, mouse
gtgatggccagagacatgag

SEQ ID NO: 837848 - DNA, 20 bp, mouse
gcatgatagggatggttaaa

SEQ ID NO: 837849 - DNA, 20 bp, mouse
gagagtgacaaatttgacac

SEQ ID NO: 837850 - DNA, 20 bp, mouse
ggtctctggccatcactagg

SEQ ID NO: 837851 - DNA, 20 bp, mouse
gaaaagggccatgtaagaag

SEQ ID NO: 837852 - DNA, 20 bp, mouse
gaggaaggactaaagtgaca

SEQ ID NO: 837853 - DNA, 20 bp, mouse
gcatgtctctggccatcact

SEQ ID NO: 837854 - DNA, 20 bp, mouse
gactttctggtctactgaaa

SEQ ID NO: 837855 - DNA, 20 bp, mouse
gtaaccatccctatcatgca

SEQ ID NO: 837856 - DNA, 20 bp, mouse
gtgggtcagctctgtctttc

SEQ ID NO: 837857 - DNA, 20 bp, mouse
ggggacattttcagagcttc

SEQ ID NO: 837858 - DNA, 20 bp, mouse
gggtggcaagtgtgacataa

SEQ ID NO: 837859 - DNA, 20 bp, mouse
gtgaaccatcagggatagga

SEQ ID NO: 837860 - DNA, 20 bp, mouse
gctctgtctttcaggagctt

SEQ ID NO: 837861 - DNA, 20 bp, mouse
gtcctgaccgtgtataaata

SEQ ID NO: 837862 - DNA, 20 bp, mouse
gaatgagagcctttcccatg

SEQ ID NO: 837863 - DNA, 20 bp, mouse
gtgcacctgagctcctgtac

SEQ ID NO: 837864 - DNA, 20 bp, mouse
gtccatatttatacacggtc

SEQ ID NO: 837865 - DNA, 20 bp, mouse
gctcattccatatttataca

SEQ ID NO: 837866 - DNA, 20 bp, mouse
gggggagtggaactgatcgc

SEQ ID NO: 837867 - DNA, 20 bp, mouse
gagtgagagatctgctgggg

SEQ ID NO: 837868 - DNA, 20 bp, mouse
gcccaacagaaggcagggtc

SEQ ID NO: 837869 - DNA, 20 bp, mouse
gtgggagtgagagatctgct

SEQ ID NO: 837870 - DNA, 20 bp, mouse
gatgctggggtaccagagac

SEQ ID NO: 837871 - DNA, 20 bp, mouse
ggtggtaacaagccttcctg

SEQ ID NO: 837872 - DNA, 20 bp, mouse
gctcaggtgtaattggggag

SEQ ID NO: 837873 - DNA, 20 bp, mouse
ggtccactcaggtgtaattg

SEQ ID NO: 837874 - DNA, 20 bp, mouse
gctgagaagtacagagacag

SEQ ID NO: 837875 - DNA, 20 bp, mouse
gggaaggaatacccaacaga

SEQ ID NO: 837876 - DNA, 20 bp, mouse
gcggcccagctgaatagata

SEQ ID NO: 837877 - DNA, 20 bp, mouse
gcgcctcccgaggcatgctg

SEQ ID NO: 837878 - DNA, 20 bp, mouse
gggcaggcgactgtacgaat

SEQ ID NO: 837879 - DNA, 20 bp, mouse
gcagaaagctgcaatggcct

SEQ ID NO: 837880 - DNA, 20 bp, mouse
gacggggcagaaagctgcaa

SEQ ID NO: 837881 - DNA, 20 bp, mouse
gccagctgaatagataggga

SEQ ID NO: 837882 - DNA, 20 bp, mouse
gggaggcggggcaagttgac

SEQ ID NO: 837883 - DNA, 20 bp, mouse
ggaatagatagggatggctc

SEQ ID NO: 837884 - DNA, 20 bp, mouse
ggctggggcttgtaggtctg

SEQ ID NO: 837885 - DNA, 20 bp, mouse
gcaaagagctgcaggtcccc

SEQ ID NO: 837886 - DNA, 20 bp, mouse
ggaggcgcggagctgcatcg

SEQ ID NO: 837887 - DNA, 20 bp, mouse
gcggagggaggcgggaactc

SEQ ID NO: 837888 - DNA, 20 bp, mouse
gcgcaccgacgtcctccgga

SEQ ID NO: 837889 - DNA, 20 bp, mouse
ggaactgggtctctatgatg

SEQ ID NO: 837890 - DNA, 20 bp, mouse
ggcccccgccctcgcgtcgc

SEQ ID NO: 837891 - DNA, 20 bp, mouse
ggtggcaacagaccacaccg

SEQ ID NO: 837892 - DNA, 20 bp, mouse
gcgcggtggtgcgggaagaa

SEQ ID NO: 837893 - DNA, 20 bp, mouse
gtggtctgttgccacccggc

SEQ ID NO: 837894 - DNA, 20 bp, mouse
gcgtacgcaccgacgtcctc

SEQ ID NO: 837895 - DNA, 20 bp, mouse
ggggctgtgacacccgagag

SEQ ID NO: 837896 - DNA, 20 bp, mouse
gtctgcagtcaaaaagggag

SEQ ID NO: 837897 - DNA, 20 bp, mouse
ggttaggggaacaacaaccc

SEQ ID NO: 837898 - DNA, 20 bp, mouse
gtgaacacctttaaacatta

SEQ ID NO: 837899 - DNA, 20 bp, mouse
ggtgaataacaataaccctt

SEQ ID NO: 837900 - DNA, 20 bp, mouse
gtgtttaaaggtgttcagtt

SEQ ID NO: 837901 - DNA, 20 bp, mouse
gattctattttcataaccaa

SEQ ID NO: 837902 - DNA, 20 bp, mouse
gtgagttccttaatgtttaa

SEQ ID NO: 837903 - DNA, 20 bp, mouse
gcaacaacccaggaatacat

SEQ ID NO: 837904 - DNA, 20 bp, mouse
gttttctctgcagtcaaaaa

SEQ ID NO: 837905 - DNA, 20 bp, mouse
gtgtgttcccatgtattcct

SEQ ID NO: 837906 - DNA, 20 bp, mouse
ggctgtcacttacatcaggt

SEQ ID NO: 837907 - DNA, 20 bp, mouse
gaacaagaaaccaggaatac

SEQ ID NO: 837908 - DNA, 20 bp, mouse
ggattaaaggtgttagatta

SEQ ID NO: 837909 - DNA, 20 bp, mouse
ggtgaataacaatagctctt

SEQ ID NO: 837910 - DNA, 20 bp, mouse
gttattcacaaattaaacaa

SEQ ID NO: 837911 - DNA, 20 bp, mouse
gtggctgccttcttgctgag

SEQ ID NO: 837912 - DNA, 20 bp, mouse
gctaacacctttaatcatta

SEQ ID NO: 837913 - DNA, 20 bp, mouse
gggccatttgttttattttc

SEQ ID NO: 837914 - DNA, 20 bp, mouse
gtgatttccttaatgattaa

SEQ ID NO: 837915 - DNA, 20 bp, mouse
gcagggactctggtcatcca

SEQ ID NO: 837916 - DNA, 20 bp, mouse
gcagtccaacaacagaagac

SEQ ID NO: 837917 - DNA, 20 bp, mouse
gggacaaaccctcagtaatt

SEQ ID NO: 837918 - DNA, 20 bp, mouse
gaagaatgcagtggtggcac

SEQ ID NO: 837919 - DNA, 20 bp, mouse
gtaccttgaaggatacttag

SEQ ID NO: 837920 - DNA, 20 bp, mouse
ggcagattctgtctagtaat

SEQ ID NO: 837921 - DNA, 20 bp, mouse
gccctcagtaatttggtaaa

SEQ ID NO: 837922 - DNA, 20 bp, mouse
gcaccactgcattcttcatc

SEQ ID NO: 837923 - DNA, 20 bp, mouse
gtggccatgcagtacagtgt

SEQ ID NO: 837924 - DNA, 20 bp, mouse
gtagacagaatctgcaacaa

SEQ ID NO: 837925 - DNA, 20 bp, mouse
gagccactaagtatccttca

SEQ ID NO: 837926 - DNA, 20 bp, mouse
ggcgcggggtctcccagagg

SEQ ID NO: 837927 - DNA, 20 bp, mouse
gcttgcgcggggtctcccag

SEQ ID NO: 837928 - DNA, 20 bp, mouse
gaccccgcgcaagacggaag

SEQ ID NO: 837929 - DNA, 20 bp, mouse
gttggagctaacggagatcg

SEQ ID NO: 837930 - DNA, 20 bp, mouse
gggaaacccgacactgcagt

SEQ ID NO: 837931 - DNA, 20 bp, mouse
gtaagcccgaccaaagtcag

SEQ ID NO: 837932 - DNA, 20 bp, mouse
gatctccgttagctccaagg

SEQ ID NO: 837933 - DNA, 20 bp, mouse
gtcagactcctggtatagat

SEQ ID NO: 837934 - DNA, 20 bp, mouse
gactcctggtatagatggga

SEQ ID NO: 837935 - DNA, 20 bp, mouse
gtgggcccaaagcagtaggg

SEQ ID NO: 837936 - DNA, 20 bp, mouse
gctagcgagagcgtgagtgg

SEQ ID NO: 837937 - DNA, 20 bp, mouse
gttcgggcggggtgtggtgc

SEQ ID NO: 837938 - DNA, 20 bp, mouse
gtggcgaggtggggttcggg

SEQ ID NO: 837939 - DNA, 20 bp, mouse
ggccctagcgagagcgtgag

SEQ ID NO: 837940 - DNA, 20 bp, mouse
ggggcctaggggaagttctt

SEQ ID NO: 837941 - DNA, 20 bp, mouse
gtgacggccccggggtcgta

SEQ ID NO: 837942 - DNA, 20 bp, mouse
gtggccctgaagtaccgctc

SEQ ID NO: 837943 - DNA, 20 bp, mouse
gacctgcggggtttagactc

SEQ ID NO: 837944 - DNA, 20 bp, mouse
ggccgtcaccctgacctgcg

SEQ ID NO: 837945 - DNA, 20 bp, mouse
gcaaagggggcgggactaat

SEQ ID NO: 837946 - DNA, 20 bp, mouse
gtagaggcgcggcaacgggg

SEQ ID NO: 837947 - DNA, 20 bp, mouse
ggtgccgcggggaggcgtgt

SEQ ID NO: 837948 - DNA, 20 bp, mouse
gcagcacacgagacttggag

SEQ ID NO: 837949 - DNA, 20 bp, mouse
gccgccgcggggcccgtccg

SEQ ID NO: 837950 - DNA, 20 bp, mouse
gggggaggcgtgtcgggcgt

SEQ ID NO: 837951 - DNA, 20 bp, mouse
ggcagctagaggcgcggcaa

SEQ ID NO: 837952 - DNA, 20 bp, mouse
gcacacgagacttggagagg

SEQ ID NO: 837953 - DNA, 20 bp, mouse
gtcggcgttgcgggagggga

SEQ ID NO: 837954 - DNA, 20 bp, mouse
gcgcactcggcgttgcggga

SEQ ID NO: 837955 - DNA, 20 bp, mouse
gggtaaaatctgcgaggcga

SEQ ID NO: 837956 - DNA, 20 bp, mouse
gtgacggctactgggtttag

SEQ ID NO: 837957 - DNA, 20 bp, mouse
gaagtggctacatgggatag

SEQ ID NO: 837958 - DNA, 20 bp, mouse
gcatctggcaattagaaaaa

SEQ ID NO: 837959 - DNA, 20 bp, mouse
gttattaggttgaatgtaag

SEQ ID NO: 837960 - DNA, 20 bp, mouse
gttgaatgtaagtggctaca

SEQ ID NO: 837961 - DNA, 20 bp, mouse
gcaatcaactgacggctact

SEQ ID NO: 837962 - DNA, 20 bp, mouse
gacttggcccaagagaacac

SEQ ID NO: 837963 - DNA, 20 bp, mouse
gaggtgtacatctaccactg

SEQ ID NO: 837964 - DNA, 20 bp, mouse
ggctgagttcaacttctgag

SEQ ID NO: 837965 - DNA, 20 bp, mouse
gttgggccaagtgctaagaa

SEQ ID NO: 837966 - DNA, 20 bp, mouse
gctggcacgtcacttccgac

SEQ ID NO: 837967 - DNA, 20 bp, mouse
gtgggtgatgtattagccag

SEQ ID NO: 837968 - DNA, 20 bp, mouse
gcatcacccaaccggaggag

SEQ ID NO: 837969 - DNA, 20 bp, mouse
ggaggggaaaagacgcacct

SEQ ID NO: 837970 - DNA, 20 bp, mouse
gaaggcggcggtgtattacg

SEQ ID NO: 837971 - DNA, 20 bp, mouse
gagagagagaaacattcact

SEQ ID NO: 837972 - DNA, 20 bp, mouse
gctgaaagaactagccacgt

SEQ ID NO: 837973 - DNA, 20 bp, mouse
gtacaggctaacccaacaat

SEQ ID NO: 837974 - DNA, 20 bp, mouse
gttaaccggcaagctgtagt

SEQ ID NO: 837975 - DNA, 20 bp, mouse
gtaatacatcacccaaccgg

SEQ ID NO: 837976 - DNA, 20 bp, mouse
gcacatgtgtgaggttcttg

SEQ ID NO: 837977 - DNA, 20 bp, mouse
gccgcatcacccaggtgtca

SEQ ID NO: 837978 - DNA, 20 bp, mouse
gcaacagtggcggtacctgg

SEQ ID NO: 837979 - DNA, 20 bp, mouse
gtaccgccactgttgaagct

SEQ ID NO: 837980 - DNA, 20 bp, mouse
ggtacctggaggataccaca

SEQ ID NO: 837981 - DNA, 20 bp, mouse
gataccttgtggtatcctcc

SEQ ID NO: 837982 - DNA, 20 bp, mouse
ggttgaagctgggactatta

SEQ ID NO: 837983 - DNA, 20 bp, mouse
gaacagtgagatgaactttg

SEQ ID NO: 837984 - DNA, 20 bp, mouse
gacctgggtgatgcggagga

SEQ ID NO: 837985 - DNA, 20 bp, mouse
gggtgtggcatattttctta

SEQ ID NO: 837986 - DNA, 20 bp, mouse
ggggcggagcctgacgaaac

SEQ ID NO: 837987 - DNA, 20 bp, mouse
ggagcctgacgaaaccggct

SEQ ID NO: 837988 - DNA, 20 bp, mouse
gtggccgcgaagaacgcgta

SEQ ID NO: 837989 - DNA, 20 bp, mouse
gggactgggcgttttctcgc

SEQ ID NO: 837990 - DNA, 20 bp, mouse
gagaaaacgcccagtccagc

SEQ ID NO: 837991 - DNA, 20 bp, mouse
gtccctccgagcgggattct

SEQ ID NO: 837992 - DNA, 20 bp, mouse
gaacgcccagtccagcggga

SEQ ID NO: 837993 - DNA, 20 bp, mouse
ggaccagtgccggaagctga

SEQ ID NO: 837994 - DNA, 20 bp, mouse
gcccacgtctcggtgatgac

SEQ ID NO: 837995 - DNA, 20 bp, mouse
gcggctgggactggagcgaa

SEQ ID NO: 837996 - DNA, 20 bp, mouse
ggcacccaggggtggtagct

SEQ ID NO: 837997 - DNA, 20 bp, mouse
gaaagcctccaagagctccg

SEQ ID NO: 837998 - DNA, 20 bp, mouse
gtcagtagtaggtaagagga

SEQ ID NO: 837999 - DNA, 20 bp, mouse
gttcaagagactgatgtcac

SEQ ID NO: 838000 - DNA, 20 bp, mouse
gcacaggagtggtggcacca

SEQ ID NO: 838001 - DNA, 20 bp, mouse
gtatcccagctaccacccct

SEQ ID NO: 838002 - DNA, 20 bp, mouse
gactgatgtcacaggagtgg

SEQ ID NO: 838003 - DNA, 20 bp, mouse
gtggtagctgggatacatac

SEQ ID NO: 838004 - DNA, 20 bp, mouse
ggagcatgtgaagacatggt

SEQ ID NO: 838005 - DNA, 20 bp, mouse
gatgctcagtagtaggtaag

SEQ ID NO: 838006 - DNA, 20 bp, mouse
gtgcttgtggagaatggcca

SEQ ID NO: 838007 - DNA, 20 bp, mouse
ggagatttgcttgtggagaa

SEQ ID NO: 838008 - DNA, 20 bp, mouse
gtagatgagcttccttaagt

SEQ ID NO: 838009 - DNA, 20 bp, mouse
gtttagaataatcccactta

SEQ ID NO: 838010 - DNA, 20 bp, mouse
gcacaagcaaatctccccca

SEQ ID NO: 838011 - DNA, 20 bp, mouse
gttagtaaaagggaggaagt

SEQ ID NO: 838012 - DNA, 20 bp, mouse
gtgatttgggacatcccttg

SEQ ID NO: 838013 - DNA, 20 bp, mouse
gggaagcattagtaaaaggg

SEQ ID NO: 838014 - DNA, 20 bp, mouse
gcccagctaaacagtgattt

SEQ ID NO: 838015 - DNA, 20 bp, mouse
gtcccaaatcactgtttagc

SEQ ID NO: 838016 - DNA, 20 bp, mouse
gtcccaaatcactatttagc

SEQ ID NO: 838017 - DNA, 20 bp, mouse
gttagaataatcccacttaa

SEQ ID NO: 838018 - DNA, 20 bp, mouse
gcacaagcaaatctccccca

SEQ ID NO: 838019 - DNA, 20 bp, mouse
gagagattgaactaacacct

SEQ ID NO: 838020 - DNA, 20 bp, mouse
gttagtaaaagggaggaagt

SEQ ID NO: 838021 - DNA, 20 bp, mouse
gtgcttgtggagattggcca

SEQ ID NO: 838022 - DNA, 20 bp, mouse
gggaagcattagtaaaaggg

SEQ ID NO: 838023 - DNA, 20 bp, mouse
gagtgatttgggacatccct

SEQ ID NO: 838024 - DNA, 20 bp, mouse
gcccagctaaatagtgattt

SEQ ID NO: 838025 - DNA, 20 bp, mouse
ggatttgggacatcccttgg

SEQ ID NO: 838026 - DNA, 20 bp, mouse
gtatctttttagatctttgg

SEQ ID NO: 838027 - DNA, 20 bp, mouse
gaaatatctttttagatctt

SEQ ID NO: 838028 - DNA, 20 bp, mouse
gttgctggaatcagagttaa

SEQ ID NO: 838029 - DNA, 20 bp, mouse
ggagcaatatgcttatcctt

SEQ ID NO: 838030 - DNA, 20 bp, mouse
gttaatagcttaacaaatga

SEQ ID NO: 838031 - DNA, 20 bp, mouse
ggttaagctattaaaaccaa

SEQ ID NO: 838032 - DNA, 20 bp, mouse
gtatttatattgatatttgc

SEQ ID NO: 838033 - DNA, 20 bp, mouse
gtctcattgcatattctagg

SEQ ID NO: 838034 - DNA, 20 bp, mouse
gagctctcattgcatattct

SEQ ID NO: 838035 - DNA, 20 bp, mouse
gggaattagaatgctgaact

SEQ ID NO: 838036 - DNA, 20 bp, mouse
gcgtgggtaaagtggaaccg

SEQ ID NO: 838037 - DNA, 20 bp, mouse
gacacctccagggagggcgt

SEQ ID NO: 838038 - DNA, 20 bp, mouse
gacagcccccggattttcaa

SEQ ID NO: 838039 - DNA, 20 bp, mouse
ggctgacggcgtgggtaaag

SEQ ID NO: 838040 - DNA, 20 bp, mouse
gagtgaaaggaggccgctga

SEQ ID NO: 838041 - DNA, 20 bp, mouse
ggggtaaagtggaaccgggg

SEQ ID NO: 838042 - DNA, 20 bp, mouse
gccgcgggaaaacgcagaaa

SEQ ID NO: 838043 - DNA, 20 bp, mouse
gtggccccttgaaaatccgg

SEQ ID NO: 838044 - DNA, 20 bp, mouse
gcggcggccgcgatcttgcc

SEQ ID NO: 838045 - DNA, 20 bp, mouse
gaagtggcgcgcgagggacg

SEQ ID NO: 838046 - DNA, 20 bp, mouse
gtggaccttgctgaacttat

SEQ ID NO: 838047 - DNA, 20 bp, mouse
ggcaaggtccacatcctcgc

SEQ ID NO: 838048 - DNA, 20 bp, mouse
gctcgcgcggcgaaaggaga

SEQ ID NO: 838049 - DNA, 20 bp, mouse
gggagggcctcgtgcagaac

SEQ ID NO: 838050 - DNA, 20 bp, mouse
gcgagtggccggcgaggatg

SEQ ID NO: 838051 - DNA, 20 bp, mouse
ggaaccgggaggaggagtct

SEQ ID NO: 838052 - DNA, 20 bp, mouse
gaggcggggcgacggctcta

SEQ ID NO: 838053 - DNA, 20 bp, mouse
gtcctcgccggccactcgcg

SEQ ID NO: 838054 - DNA, 20 bp, mouse
ggtcactctggaggacgaca

SEQ ID NO: 838055 - DNA, 20 bp, mouse
gggcctcgtgcagaaccggg

SEQ ID NO: 838056 - DNA, 20 bp, mouse
ggatgcaagcttctaatagg

SEQ ID NO: 838057 - DNA, 20 bp, mouse
gcggactagtgcatccatga

SEQ ID NO: 838058 - DNA, 20 bp, mouse
gggaagggaggggatgtaaa

SEQ ID NO: 838059 - DNA, 20 bp, mouse
gagggggtgggtaacatgga

SEQ ID NO: 838060 - DNA, 20 bp, mouse
gcaaaggcggtctagggggt

SEQ ID NO: 838061 - DNA, 20 bp, mouse
gtctccaaaggcggtctagg

SEQ ID NO: 838062 - DNA, 20 bp, mouse
gggcgggcacagtagggcca

SEQ ID NO: 838063 - DNA, 20 bp, mouse
gcgaacccggggcttaatgc

SEQ ID NO: 838064 - DNA, 20 bp, mouse
gaggtctgaggaagttgtac

SEQ ID NO: 838065 - DNA, 20 bp, mouse
gaggagccgggtggggtgaa

SEQ ID NO: 838066 - DNA, 20 bp, mouse
gctgggtagaagtctcaaga

SEQ ID NO: 838067 - DNA, 20 bp, mouse
gagaatgtgaggggattcat

SEQ ID NO: 838068 - DNA, 20 bp, mouse
gagcagagctgcggaggggt

SEQ ID NO: 838069 - DNA, 20 bp, mouse
gtcgccaccgccgcacccac

SEQ ID NO: 838070 - DNA, 20 bp, mouse
gcgaggccggccagccctcc

SEQ ID NO: 838071 - DNA, 20 bp, mouse
gacccggagcgagaatgtga

SEQ ID NO: 838072 - DNA, 20 bp, mouse
gggcgagcagagctgcggag

SEQ ID NO: 838073 - DNA, 20 bp, mouse
ggaggcggtgggactgccag

SEQ ID NO: 838074 - DNA, 20 bp, mouse
gcccttggccagggtcccaa

SEQ ID NO: 838075 - DNA, 20 bp, mouse
gtgctgaccggtgggtgcgg

SEQ ID NO: 838076 - DNA, 20 bp, mouse
gctgagagcgggcagttgaa

SEQ ID NO: 838077 - DNA, 20 bp, mouse
ggcacctgagcagaagtgca

SEQ ID NO: 838078 - DNA, 20 bp, mouse
ggtagtgggtagctgtgttt

SEQ ID NO: 838079 - DNA, 20 bp, mouse
gtacccactacagcagaccc

SEQ ID NO: 838080 - DNA, 20 bp, mouse
gtggttggggagtctcatgg

SEQ ID NO: 838081 - DNA, 20 bp, mouse
ggggaagatgagtggggaaa

SEQ ID NO: 838082 - DNA, 20 bp, mouse
gcagaaggctcaagagaaca

SEQ ID NO: 838083 - DNA, 20 bp, mouse
gttggggagtctcatggagg

SEQ ID NO: 838084 - DNA, 20 bp, mouse
gtatcaagtccaatgtaggt

SEQ ID NO: 838085 - DNA, 20 bp, mouse
ggagatctccctgggctaac

SEQ ID NO: 838086 - DNA, 20 bp, mouse
gtgtacaaaaccagctgtgg

SEQ ID NO: 838087 - DNA, 20 bp, mouse
gctggttttgtacacttctg

SEQ ID NO: 838088 - DNA, 20 bp, mouse
gaagtgtacaaaaccagctg

SEQ ID NO: 838089 - DNA, 20 bp, mouse
gagtgcttacctatcaagca

SEQ ID NO: 838090 - DNA, 20 bp, mouse
gccagccaatgctgatatga

SEQ ID NO: 838091 - DNA, 20 bp, mouse
gtcagtcagtggggttctgc

SEQ ID NO: 838092 - DNA, 20 bp, mouse
gcaagcatggagcactggga

SEQ ID NO: 838093 - DNA, 20 bp, mouse
ggggctcaccagctgcccca

SEQ ID NO: 838094 - DNA, 20 bp, mouse
gtaatctggaggagaccatg

SEQ ID NO: 838095 - DNA, 20 bp, mouse
ggggtaacttcctcagtcag

SEQ ID NO: 838096 - DNA, 20 bp, mouse
gtgaggctcagagtcatagt

SEQ ID NO: 838097 - DNA, 20 bp, mouse
gagatgctggggttacatgg

SEQ ID NO: 838098 - DNA, 20 bp, mouse
gggagggggcggcaggatag

SEQ ID NO: 838099 - DNA, 20 bp, mouse
gggcgctaggatcagaatcc

SEQ ID NO: 838100 - DNA, 20 bp, mouse
gggaagggaaaatatgacag

SEQ ID NO: 838101 - DNA, 20 bp, mouse
gcagagtcatagtaggcgct

SEQ ID NO: 838102 - DNA, 20 bp, mouse
gtttccccgtctgggaaaaa

SEQ ID NO: 838103 - DNA, 20 bp, mouse
gaagtccttttttcccagac

SEQ ID NO: 838104 - DNA, 20 bp, mouse
gtgttcatgcgcaaggctct

SEQ ID NO: 838105 - DNA, 20 bp, mouse
ggagcctcagtttccccgtc

SEQ ID NO: 838106 - DNA, 20 bp, mouse
ggtgccaggtcagaggtgaa

SEQ ID NO: 838107 - DNA, 20 bp, mouse
gggagagcgtgccaggtcag

SEQ ID NO: 838108 - DNA, 20 bp, mouse
gaagggggggagtgacgctc

SEQ ID NO: 838109 - DNA, 20 bp, mouse
gctagggaaagctagagtgg

SEQ ID NO: 838110 - DNA, 20 bp, mouse
gtaagacggaggtcctccaa

SEQ ID NO: 838111 - DNA, 20 bp, mouse
gaagtaaaaaacagacgggt

SEQ ID NO: 838112 - DNA, 20 bp, mouse
gcccccgcccccaggcaatg

SEQ ID NO: 838113 - DNA, 20 bp, mouse
gtattcatgcgaggggccta

SEQ ID NO: 838114 - DNA, 20 bp, mouse
ggatttagagatgcgttttg

SEQ ID NO: 838115 - DNA, 20 bp, mouse
ggagtgacgctctggcccct

SEQ ID NO: 838116 - DNA, 20 bp, mouse
ggggtggctaggaatggtat

SEQ ID NO: 838117 - DNA, 20 bp, mouse
gctaggagggccgggatcac

SEQ ID NO: 838118 - DNA, 20 bp, mouse
gcatggagaccaatgttcac

SEQ ID NO: 838119 - DNA, 20 bp, mouse
ggagtggccctgactcattc

SEQ ID NO: 838120 - DNA, 20 bp, mouse
gaccccttcctgaatgagtc

SEQ ID NO: 838121 - DNA, 20 bp, mouse
gaacattggtctccatgttc

SEQ ID NO: 838122 - DNA, 20 bp, mouse
gccctgactcattcaggaag

SEQ ID NO: 838123 - DNA, 20 bp, mouse
gagagtgcatgattcagaaa

SEQ ID NO: 838124 - DNA, 20 bp, mouse
gggtctccatgttctggctt

SEQ ID NO: 838125 - DNA, 20 bp, mouse
gcagctgtccccggactgag

SEQ ID NO: 838126 - DNA, 20 bp, mouse
ggccctggggagtaagagag

SEQ ID NO: 838127 - DNA, 20 bp, mouse
gttagcaggggttatgaagg

SEQ ID NO: 838128 - DNA, 20 bp, mouse
gtacaagtcccatttagcag

SEQ ID NO: 838129 - DNA, 20 bp, mouse
gtcttcccaagtgctcacga

SEQ ID NO: 838130 - DNA, 20 bp, mouse
gttgggaagaacttagtgac

SEQ ID NO: 838131 - DNA, 20 bp, mouse
gcaggcagatggattctgac

SEQ ID NO: 838132 - DNA, 20 bp, mouse
gctgacaggtgacagagaac

SEQ ID NO: 838133 - DNA, 20 bp, mouse
gtgcctgtcactggcttata

SEQ ID NO: 838134 - DNA, 20 bp, mouse
gggagtcaacattcttgccc

SEQ ID NO: 838135 - DNA, 20 bp, mouse
gccaagtgctcacgagggca

SEQ ID NO: 838136 - DNA, 20 bp, mouse
gttgccccggccagagggga

SEQ ID NO: 838137 - DNA, 20 bp, mouse
ggcccgggacaactactctg

SEQ ID NO: 838138 - DNA, 20 bp, mouse
ggaggggagggagggttcca

SEQ ID NO: 838139 - DNA, 20 bp, mouse
ggggtcaggatgtttatgtg

SEQ ID NO: 838140 - DNA, 20 bp, mouse
gccctctggccggggcaata

SEQ ID NO: 838141 - DNA, 20 bp, mouse
ggtctgggggctacaggtta

SEQ ID NO: 838142 - DNA, 20 bp, mouse
gggctacaggttagggcgac

SEQ ID NO: 838143 - DNA, 20 bp, mouse
ggactccagcaggaaggtct

SEQ ID NO: 838144 - DNA, 20 bp, mouse
ggggtctggccttattgccc

SEQ ID NO: 838145 - DNA, 20 bp, mouse
gttcctgctggagtcgggtc

SEQ ID NO: 838146 - DNA, 20 bp, mouse
gccaggcgataaaaccctca

SEQ ID NO: 838147 - DNA, 20 bp, mouse
gaacccaaaagcaggggaac

SEQ ID NO: 838148 - DNA, 20 bp, mouse
gctgaagaggtgacagtcat

SEQ ID NO: 838149 - DNA, 20 bp, mouse
gagcctctaaatgtgagtta

SEQ ID NO: 838150 - DNA, 20 bp, mouse
gtggacttgttgctgtcacc

SEQ ID NO: 838151 - DNA, 20 bp, mouse
gggcctgttcccctgctttt

SEQ ID NO: 838152 - DNA, 20 bp, mouse
ggcaggggaacaggccctga

SEQ ID NO: 838153 - DNA, 20 bp, mouse
gcaagcaagttctaccactg

SEQ ID NO: 838154 - DNA, 20 bp, mouse
ggactgggggtgttcctcag

SEQ ID NO: 838155 - DNA, 20 bp, mouse
gctggggaaggcaactttgt

SEQ ID NO: 838156 - DNA, 20 bp, mouse
gtggcgccaggacctcgcga

SEQ ID NO: 838157 - DNA, 20 bp, mouse
ggtcgcgccttgggggggaa

SEQ ID NO: 838158 - DNA, 20 bp, mouse
ggccgcccgcgctctctcat

SEQ ID NO: 838159 - DNA, 20 bp, mouse
gtccgccaatgagagagcgc

SEQ ID NO: 838160 - DNA, 20 bp, mouse
gtctggaggcggctggctga

SEQ ID NO: 838161 - DNA, 20 bp, mouse
ggaaagcgcacgggcggcag

SEQ ID NO: 838162 - DNA, 20 bp, mouse
ggcgcctggccctcggccgt

SEQ ID NO: 838163 - DNA, 20 bp, mouse
ggcgcggcgcggaaagcgca

SEQ ID NO: 838164 - DNA, 20 bp, mouse
gtgcgcaggcgcctggccct

SEQ ID NO: 838165 - DNA, 20 bp, mouse
gggcggcctttgaacaccaa

SEQ ID NO: 838166 - DNA, 20 bp, mouse
ggcggggctgacccctgtgc

SEQ ID NO: 838167 - DNA, 20 bp, mouse
gaaaaggtgactgcatttga

SEQ ID NO: 838168 - DNA, 20 bp, mouse
ggactccaggaaaaaggggc

SEQ ID NO: 838169 - DNA, 20 bp, mouse
ggatgccctagacaagtcta

SEQ ID NO: 838170 - DNA, 20 bp, mouse
gctggctgggaccaaacccc

SEQ ID NO: 838171 - DNA, 20 bp, mouse
gcacacaggtaatttaaagt

SEQ ID NO: 838172 - DNA, 20 bp, mouse
gtcttcgcatttctgacccg

SEQ ID NO: 838173 - DNA, 20 bp, mouse
ggactggaactggactgtaa

SEQ ID NO: 838174 - DNA, 20 bp, mouse
gcaggcccgcccctttttcc

SEQ ID NO: 838175 - DNA, 20 bp, mouse
gagccggactccaggaaaaa

SEQ ID NO: 838176 - DNA, 20 bp, mouse
gtagcaagactcggagaagg

SEQ ID NO: 838177 - DNA, 20 bp, mouse
gacagtgggtttgatttcga

SEQ ID NO: 838178 - DNA, 20 bp, mouse
gcaactccgtaagctctgga

SEQ ID NO: 838179 - DNA, 20 bp, mouse
gtctccgagtcttgctacag

SEQ ID NO: 838180 - DNA, 20 bp, mouse
gcagcctgcatgtcttgaca

SEQ ID NO: 838181 - DNA, 20 bp, mouse
gccagaagcaattcagtgat

SEQ ID NO: 838182 - DNA, 20 bp, mouse
gaaggcgtgtctctgggtcg

SEQ ID NO: 838183 - DNA, 20 bp, mouse
gggaacaactccgtaagctc

SEQ ID NO: 838184 - DNA, 20 bp, mouse
gaagccacctgatgctcttc

SEQ ID NO: 838185 - DNA, 20 bp, mouse
gacgccttaatgggcaccaa

SEQ ID NO: 838186 - DNA, 20 bp, mouse
gtagcaagactcggagaagg

SEQ ID NO: 838187 - DNA, 20 bp, mouse
gacagtgggtttgatttcga

SEQ ID NO: 838188 - DNA, 20 bp, mouse
gcaactccgtaagctctgga

SEQ ID NO: 838189 - DNA, 20 bp, mouse
gtctccgagtcttgctacag

SEQ ID NO: 838190 - DNA, 20 bp, mouse
gcagcctgcatgtcttgaca

SEQ ID NO: 838191 - DNA, 20 bp, mouse
gccagaagcaattcagtgat

SEQ ID NO: 838192 - DNA, 20 bp, mouse
gaaggcgtgtctctgggtcg

SEQ ID NO: 838193 - DNA, 20 bp, mouse
gggaacaactccgtaagctc

SEQ ID NO: 838194 - DNA, 20 bp, mouse
gaagccacctgatgctcttc

SEQ ID NO: 838195 - DNA, 20 bp, mouse
gacgccttaatgggcaccaa

SEQ ID NO: 838196 - DNA, 20 bp, mouse
ggcacagtggcagcgaggcg

SEQ ID NO: 838197 - DNA, 20 bp, mouse
gaggctgcgctggaccgaag

SEQ ID NO: 838198 - DNA, 20 bp, mouse
gcgcgcggggccgggatctg

SEQ ID NO: 838199 - DNA, 20 bp, mouse
gcagggtcgggcagctgagt

SEQ ID NO: 838200 - DNA, 20 bp, mouse
gttgcccggcagagcagagg

SEQ ID NO: 838201 - DNA, 20 bp, mouse
gggccggcgcggcgcgattg

SEQ ID NO: 838202 - DNA, 20 bp, mouse
ggacccgaaaagctttgaga

SEQ ID NO: 838203 - DNA, 20 bp, mouse
gccggtgctcgcatcccggg

SEQ ID NO: 838204 - DNA, 20 bp, mouse
gcgaccctggccgcagatcc

SEQ ID NO: 838205 - DNA, 20 bp, mouse
gcgagggcgtcccaaggaag

SEQ ID NO: 838206 - DNA, 20 bp, mouse
gcgctgttgccctgccgtgg

SEQ ID NO: 838207 - DNA, 20 bp, mouse
gcccgcccctccagtcaatt

SEQ ID NO: 838208 - DNA, 20 bp, mouse
gtgttcagagccaggttcag

SEQ ID NO: 838209 - DNA, 20 bp, mouse
gtctggctctcccctgaacc

SEQ ID NO: 838210 - DNA, 20 bp, mouse
ggccctctcagatcacatgc

SEQ ID NO: 838211 - DNA, 20 bp, mouse
gccctgcatgtgatctgaga

SEQ ID NO: 838212 - DNA, 20 bp, mouse
gaatcgctgttgccctgccg

SEQ ID NO: 838213 - DNA, 20 bp, mouse
gcctccaggcctcaaagatt

SEQ ID NO: 838214 - DNA, 20 bp, mouse
gtgcaggaaactagggtatc

SEQ ID NO: 838215 - DNA, 20 bp, mouse
gccaacttctgcaggaaact

SEQ ID NO: 838216 - DNA, 20 bp, mouse
gtcagaaggcgggcaagcaa

SEQ ID NO: 838217 - DNA, 20 bp, mouse
gctcccagtgcgtcagaagg

SEQ ID NO: 838218 - DNA, 20 bp, mouse
gaatagtcagggtggaccgg

SEQ ID NO: 838219 - DNA, 20 bp, mouse
gcccccccaaaaaagagtct

SEQ ID NO: 838220 - DNA, 20 bp, mouse
gggaaggaacacaaatagtc

SEQ ID NO: 838221 - DNA, 20 bp, mouse
gggaacacaaatagtcaggg

SEQ ID NO: 838222 - DNA, 20 bp, mouse
gtgcccgccttctgacgcac

SEQ ID NO: 838223 - DNA, 20 bp, mouse
ggcctggagcccccactgtg

SEQ ID NO: 838224 - DNA, 20 bp, mouse
gacaaatagtcagggtggac

SEQ ID NO: 838225 - DNA, 20 bp, mouse
gcagctcccagtgcgtcaga

SEQ ID NO: 838226 - DNA, 20 bp, mouse
gaaaataggggtgagttgga

SEQ ID NO: 838227 - DNA, 20 bp, mouse
gcactctcctgcagtacagg

SEQ ID NO: 838228 - DNA, 20 bp, mouse
gggagggaagacttcaggat

SEQ ID NO: 838229 - DNA, 20 bp, mouse
gtactgcaggagagtgcagg

SEQ ID NO: 838230 - DNA, 20 bp, mouse
gcagtcacacacaagccggg

SEQ ID NO: 838231 - DNA, 20 bp, mouse
gggacaatactgtaagtaac

SEQ ID NO: 838232 - DNA, 20 bp, mouse
ggcacagagcaatcagaggt

SEQ ID NO: 838233 - DNA, 20 bp, mouse
ggggaacagagagagctgcc

SEQ ID NO: 838234 - DNA, 20 bp, mouse
ggtgtgactgtgtctccccg

SEQ ID NO: 838235 - DNA, 20 bp, mouse
ggacacagtcacacacaagc

SEQ ID NO: 838236 - DNA, 20 bp, mouse
ggcgggtcggagggcttcgt

SEQ ID NO: 838237 - DNA, 20 bp, mouse
gttcgtggggaggatcattg

SEQ ID NO: 838238 - DNA, 20 bp, mouse
gaatgagggctcgcctctcg

SEQ ID NO: 838239 - DNA, 20 bp, mouse
ggtggagaactgctccgtta

SEQ ID NO: 838240 - DNA, 20 bp, mouse
ggtcggagggcttcgtgggg

SEQ ID NO: 838241 - DNA, 20 bp, mouse
gctctcgcggctggcagtca

SEQ ID NO: 838242 - DNA, 20 bp, mouse
ggcagtcaggggcgggtcgg

SEQ ID NO: 838243 - DNA, 20 bp, mouse
gctggcagtcaggggcgggt

SEQ ID NO: 838244 - DNA, 20 bp, mouse
ggtaaacagcggtccctaaa

SEQ ID NO: 838245 - DNA, 20 bp, mouse
ggtgcagtctccatccgtaa

SEQ ID NO: 838246 - DNA, 20 bp, mouse
gggcaagcgaacagccaatc

SEQ ID NO: 838247 - DNA, 20 bp, mouse
gtaggtagctgaattcaacc

SEQ ID NO: 838248 - DNA, 20 bp, mouse
ggcactcagagtggcctgat

SEQ ID NO: 838249 - DNA, 20 bp, mouse
gcaggacccacccactgcgc

SEQ ID NO: 838250 - DNA, 20 bp, mouse
ggagtgcagaagtgattcgt

SEQ ID NO: 838251 - DNA, 20 bp, mouse
gcgggcgcggctcttgcctt

SEQ ID NO: 838252 - DNA, 20 bp, mouse
ggaagccgcgatagcagcgg

SEQ ID NO: 838253 - DNA, 20 bp, mouse
gccggctgcgcacccacgct

SEQ ID NO: 838254 - DNA, 20 bp, mouse
gacttgcagctcgtgttcca

SEQ ID NO: 838255 - DNA, 20 bp, mouse
gtgggtgggtcctgcagctc

SEQ ID NO: 838256 - DNA, 20 bp, mouse
gtgggaatgaggctgctcga

SEQ ID NO: 838257 - DNA, 20 bp, mouse
ggagatagacaaactctgat

SEQ ID NO: 838258 - DNA, 20 bp, mouse
gctcgagtgtgtgtcatgta

SEQ ID NO: 838259 - DNA, 20 bp, mouse
gagacaaactctgattggat

SEQ ID NO: 838260 - DNA, 20 bp, mouse
gagaggtggatcaaattccc

SEQ ID NO: 838261 - DNA, 20 bp, mouse
gaaactgtcacggaacctgc

SEQ ID NO: 838262 - DNA, 20 bp, mouse
gccctgaaaggctctgtgtc

SEQ ID NO: 838263 - DNA, 20 bp, mouse
ggctctgtgtctggaggtga

SEQ ID NO: 838264 - DNA, 20 bp, mouse
gaagagaagccgctccagtc

SEQ ID NO: 838265 - DNA, 20 bp, mouse
gcctttcaggggtagctgtt

SEQ ID NO: 838266 - DNA, 20 bp, mouse
gctgactgggccatactggg

SEQ ID NO: 838267 - DNA, 20 bp, mouse
ggggcggcctagaaaggcgg

SEQ ID NO: 838268 - DNA, 20 bp, mouse
gtggaaggggggtcgacaaa

SEQ ID NO: 838269 - DNA, 20 bp, mouse
gactgggcggcctagaaagg

SEQ ID NO: 838270 - DNA, 20 bp, mouse
gcctagaaaggcggtggaag

SEQ ID NO: 838271 - DNA, 20 bp, mouse
gcagcagtagggaactgtcg

SEQ ID NO: 838272 - DNA, 20 bp, mouse
gaaaagggagatcggggcta

SEQ ID NO: 838273 - DNA, 20 bp, mouse
ggtcgacaaaagggagatcg

SEQ ID NO: 838274 - DNA, 20 bp, mouse
ggtagggaactgtcggggac

SEQ ID NO: 838275 - DNA, 20 bp, mouse
gtcagcctaggtcagctact

SEQ ID NO: 838276 - DNA, 20 bp, mouse
gtcccccgctccggccgcgg

SEQ ID NO: 838277 - DNA, 20 bp, mouse
gaaagccggccgggccaaga

SEQ ID NO: 838278 - DNA, 20 bp, mouse
gacgacctttggaacctcct

SEQ ID NO: 838279 - DNA, 20 bp, mouse
ggggaggcgtacacaaaagc

SEQ ID NO: 838280 - DNA, 20 bp, mouse
gtcctcccccgctccggccg

SEQ ID NO: 838281 - DNA, 20 bp, mouse
gtctcccccgcggccggagc

SEQ ID NO: 838282 - DNA, 20 bp, mouse
gtccaaaggtcgtcacactg

SEQ ID NO: 838283 - DNA, 20 bp, mouse
gctcgcccaggaggttccaa

SEQ ID NO: 838284 - DNA, 20 bp, mouse
gttgcctggaaccccctccc

SEQ ID NO: 838285 - DNA, 20 bp, mouse
ggtggccatcagcttccaag

SEQ ID NO: 838286 - DNA, 20 bp, mouse
gggtggatgcaacaggtgat

SEQ ID NO: 838287 - DNA, 20 bp, mouse
gtggagtgtgagcagtcagt

SEQ ID NO: 838288 - DNA, 20 bp, mouse
gtttcccgaaagctgtggga

SEQ ID NO: 838289 - DNA, 20 bp, mouse
ggccactgaactatctggga

SEQ ID NO: 838290 - DNA, 20 bp, mouse
gttaaccaacaatgtcaagg

SEQ ID NO: 838291 - DNA, 20 bp, mouse
gcgggaaactgttctaaatg

SEQ ID NO: 838292 - DNA, 20 bp, mouse
gccctacagcacttccactc

SEQ ID NO: 838293 - DNA, 20 bp, mouse
gaccctcccagatagttcag

SEQ ID NO: 838294 - DNA, 20 bp, mouse
gctgaggaaaggactaggcc

SEQ ID NO: 838295 - DNA, 20 bp, mouse
gttagcaccattagcgtaag

SEQ ID NO: 838296 - DNA, 20 bp, mouse
ggtctggcatgtaaatgagt

SEQ ID NO: 838297 - DNA, 20 bp, mouse
gtctgctgaacatcatctca

SEQ ID NO: 838298 - DNA, 20 bp, mouse
gttcagcagaacaaggacca

SEQ ID NO: 838299 - DNA, 20 bp, mouse
gccttgagctactacacctg

SEQ ID NO: 838300 - DNA, 20 bp, mouse
gctccagccctgttcttcac

SEQ ID NO: 838301 - DNA, 20 bp, mouse
gcctctgctattaattacat

SEQ ID NO: 838302 - DNA, 20 bp, mouse
gagaggaccaggtacagagt

SEQ ID NO: 838303 - DNA, 20 bp, mouse
gtgagttggctcattattca

SEQ ID NO: 838304 - DNA, 20 bp, mouse
gaagtgaaagcaaccaggac

SEQ ID NO: 838305 - DNA, 20 bp, mouse
gtggctactggaaaacaccc

SEQ ID NO: 838306 - DNA, 20 bp, mouse
gagaagcccgggaggtgctc

SEQ ID NO: 838307 - DNA, 20 bp, mouse
gagcgcagaagtagcgacga

SEQ ID NO: 838308 - DNA, 20 bp, mouse
gagggagggagaagcccggg

SEQ ID NO: 838309 - DNA, 20 bp, mouse
gccagtgcggggacagggag

SEQ ID NO: 838310 - DNA, 20 bp, mouse
gaaaaggcaaccagagaggg

SEQ ID NO: 838311 - DNA, 20 bp, mouse
gcccgcccagtgcggggaca

SEQ ID NO: 838312 - DNA, 20 bp, mouse
gagcgacgagggggtcaggc

SEQ ID NO: 838313 - DNA, 20 bp, mouse
gaagtagcgacgagggggtc

SEQ ID NO: 838314 - DNA, 20 bp, mouse
gagggagtggggtctctccg

SEQ ID NO: 838315 - DNA, 20 bp, mouse
ggggcgcctcgcctgcgctg

SEQ ID NO: 838316 - DNA, 20 bp, mouse
gctcctctgcaggtcgctga

SEQ ID NO: 838317 - DNA, 20 bp, mouse
gccgccccgccagggagcgg

SEQ ID NO: 838318 - DNA, 20 bp, mouse
ggcggggctagcagtgggaa

SEQ ID NO: 838319 - DNA, 20 bp, mouse
gccagggagcggaggctcat

SEQ ID NO: 838320 - DNA, 20 bp, mouse
gaggagacggacaaggcggg

SEQ ID NO: 838321 - DNA, 20 bp, mouse
gcagccagcaggcgatgccg

SEQ ID NO: 838322 - DNA, 20 bp, mouse
ggagaggagacggacaaggc

SEQ ID NO: 838323 - DNA, 20 bp, mouse
gcgctgagggctctatgagt

SEQ ID NO: 838324 - DNA, 20 bp, mouse
ggcgcaagccgagaagaagt

SEQ ID NO: 838325 - DNA, 20 bp, mouse
gaacccctcccggtcgcgag

SEQ ID NO: 838326 - DNA, 20 bp, mouse
ggatactagcatttagcatg

SEQ ID NO: 838327 - DNA, 20 bp, mouse
ggtcaagtgcggtctactga

SEQ ID NO: 838328 - DNA, 20 bp, mouse
ggacctctacaatttttgtg

SEQ ID NO: 838329 - DNA, 20 bp, mouse
gaggtcaaggaatagttcaa

SEQ ID NO: 838330 - DNA, 20 bp, mouse
ggacttaatgtggaactcct

SEQ ID NO: 838331 - DNA, 20 bp, mouse
ggtatctgatataattggat

SEQ ID NO: 838332 - DNA, 20 bp, mouse
ggctagttcctgtatgtaaa

SEQ ID NO: 838333 - DNA, 20 bp, mouse
gctggagcgtatgtatcatt

SEQ ID NO: 838334 - DNA, 20 bp, mouse
gcagaaaatgaattacttag

SEQ ID NO: 838335 - DNA, 20 bp, mouse
gcgtttaaacacatgggctt

SEQ ID NO: 838336 - DNA, 20 bp, mouse
gctggccccacctcctaggt

SEQ ID NO: 838337 - DNA, 20 bp, mouse
gcggaccaatccggtaataa

SEQ ID NO: 838338 - DNA, 20 bp, mouse
ggatagtccctgaattggaa

SEQ ID NO: 838339 - DNA, 20 bp, mouse
ggggcctgagatcacaccca

SEQ ID NO: 838340 - DNA, 20 bp, mouse
ggaagtggacccaggataag

SEQ ID NO: 838341 - DNA, 20 bp, mouse
gtcgacctttattaccggat

SEQ ID NO: 838342 - DNA, 20 bp, mouse
gatctcaggcccagacagat

SEQ ID NO: 838343 - DNA, 20 bp, mouse
gggaactcacctcttatcct

SEQ ID NO: 838344 - DNA, 20 bp, mouse
gtctgtgatccaagctgggt

SEQ ID NO: 838345 - DNA, 20 bp, mouse
gactcagcctttccaattca

SEQ ID NO: 838346 - DNA, 20 bp, mouse
gcccggagggcgaaatggag

SEQ ID NO: 838347 - DNA, 20 bp, mouse
gggtgggcggggccttttgt

SEQ ID NO: 838348 - DNA, 20 bp, mouse
ggagcccgggtgaaaggaaa

SEQ ID NO: 838349 - DNA, 20 bp, mouse
gcgtgggctcggctggtggg

SEQ ID NO: 838350 - DNA, 20 bp, mouse
ggggccgagcgaccaggata

SEQ ID NO: 838351 - DNA, 20 bp, mouse
gtcgttagcggccggagcgt

SEQ ID NO: 838352 - DNA, 20 bp, mouse
ggagtggctgagagagaacg

SEQ ID NO: 838353 - DNA, 20 bp, mouse
gccctccgggctcccaggcg

SEQ ID NO: 838354 - DNA, 20 bp, mouse
ggaggggcttcgggaatttc

SEQ ID NO: 838355 - DNA, 20 bp, mouse
gccgagggagcccgggtgaa

SEQ ID NO: 838356 - DNA, 20 bp, mouse
ggggtggcgggaggaccaat

SEQ ID NO: 838357 - DNA, 20 bp, mouse
gggtccgcccgggtcctccc

SEQ ID NO: 838358 - DNA, 20 bp, mouse
gaagccggggcaaacagcgg

SEQ ID NO: 838359 - DNA, 20 bp, mouse
gacgacggggcgggcggatg

SEQ ID NO: 838360 - DNA, 20 bp, mouse
ggggcggggcctgtacgacg

SEQ ID NO: 838361 - DNA, 20 bp, mouse
gggggcctgtacgacggggc

SEQ ID NO: 838362 - DNA, 20 bp, mouse
gtagaagccggggcaaacag

SEQ ID NO: 838363 - DNA, 20 bp, mouse
gcggcggttcgcaggaagga

SEQ ID NO: 838364 - DNA, 20 bp, mouse
gacccggccctcgctcccat

SEQ ID NO: 838365 - DNA, 20 bp, mouse
gtctccggccggcggttcgc

SEQ ID NO: 838366 - DNA, 20 bp, mouse
gtgggggctcggcagagtag

SEQ ID NO: 838367 - DNA, 20 bp, mouse
gccccagcggggggctctga

SEQ ID NO: 838368 - DNA, 20 bp, mouse
gcgaaggggcgttgtaatct

SEQ ID NO: 838369 - DNA, 20 bp, mouse
gactctgccgagcccccagc

SEQ ID NO: 838370 - DNA, 20 bp, mouse
gtccctccggccacagagat

SEQ ID NO: 838371 - DNA, 20 bp, mouse
gatgccccgccccccattaa

SEQ ID NO: 838372 - DNA, 20 bp, mouse
ggggctgagtctccggtgga

SEQ ID NO: 838373 - DNA, 20 bp, mouse
gccatggagtggggacacgt

SEQ ID NO: 838374 - DNA, 20 bp, mouse
gatggcagaggagagaaata

SEQ ID NO: 838375 - DNA, 20 bp, mouse
gaggcgtggaaaggcacgaa

SEQ ID NO: 838376 - DNA, 20 bp, mouse
gtacgcggaagtcacggatc

SEQ ID NO: 838377 - DNA, 20 bp, mouse
gaaggaccgtgggatcgcgg

SEQ ID NO: 838378 - DNA, 20 bp, mouse
gtaacctgcggaactttagg

SEQ ID NO: 838379 - DNA, 20 bp, mouse
ggatcagaaggcactgtcaa

SEQ ID NO: 838380 - DNA, 20 bp, mouse
gaccgaaaaggcagtggcgg

SEQ ID NO: 838381 - DNA, 20 bp, mouse
gcccgggcgcgaaggaccgt

SEQ ID NO: 838382 - DNA, 20 bp, mouse
gccgctgccagaggcgtccc

SEQ ID NO: 838383 - DNA, 20 bp, mouse
ggagaccgaaaaggcagtgg

SEQ ID NO: 838384 - DNA, 20 bp, mouse
gcgcggaggaccaagtaaat

SEQ ID NO: 838385 - DNA, 20 bp, mouse
ggtggagaccgaaaaggcag

SEQ ID NO: 838386 - DNA, 20 bp, mouse
gccctccaagggaccaggaa

SEQ ID NO: 838387 - DNA, 20 bp, mouse
ggggatcggaaggagactgg

SEQ ID NO: 838388 - DNA, 20 bp, mouse
gacaggatgcgctgtcaata

SEQ ID NO: 838389 - DNA, 20 bp, mouse
gccagcggagggataccaag

SEQ ID NO: 838390 - DNA, 20 bp, mouse
gagcggggctggcccagcgg

SEQ ID NO: 838391 - DNA, 20 bp, mouse
gtcgagttgaacgttgcgga

SEQ ID NO: 838392 - DNA, 20 bp, mouse
gggagggatcggaaggagac

SEQ ID NO: 838393 - DNA, 20 bp, mouse
gccgatccctccaagggacc

SEQ ID NO: 838394 - DNA, 20 bp, mouse
gtgctagcgcggaggggcgg

SEQ ID NO: 838395 - DNA, 20 bp, mouse
ggcgctgtcaatagggagcg

SEQ ID NO: 838396 - DNA, 20 bp, mouse
gacccggaagcacttggcgg

SEQ ID NO: 838397 - DNA, 20 bp, mouse
ggctgagatagcacgggatc

SEQ ID NO: 838398 - DNA, 20 bp, mouse
gcacgggatccggtgagaag

SEQ ID NO: 838399 - DNA, 20 bp, mouse
gaccggcagccgcttctcac

SEQ ID NO: 838400 - DNA, 20 bp, mouse
gggaaggcgttccaggggaa

SEQ ID NO: 838401 - DNA, 20 bp, mouse
gaagcacttggcggtggcga

SEQ ID NO: 838402 - DNA, 20 bp, mouse
gaaggtgcggatcccacggg

SEQ ID NO: 838403 - DNA, 20 bp, mouse
gaatggcgctcgtcctacga

SEQ ID NO: 838404 - DNA, 20 bp, mouse
ggcaggggaaggcgttccag

SEQ ID NO: 838405 - DNA, 20 bp, mouse
gcggcagattcgaagctcgg

SEQ ID NO: 838406 - DNA, 20 bp, mouse
gtacgagtgagaaacgtgct

SEQ ID NO: 838407 - DNA, 20 bp, mouse
gacgtgctcggatgattctt

SEQ ID NO: 838408 - DNA, 20 bp, mouse
gccgccccgctcggtcgcgc

SEQ ID NO: 838409 - DNA, 20 bp, mouse
gaaagaaagtaggaccacaa

SEQ ID NO: 838410 - DNA, 20 bp, mouse
ggaagcctgcgcgaccgagc

SEQ ID NO: 838411 - DNA, 20 bp, mouse
gctgcgaagggaaccagtcc

SEQ ID NO: 838412 - DNA, 20 bp, mouse
ggcaactccaggacgaccag

SEQ ID NO: 838413 - DNA, 20 bp, mouse
ggacgaggtcggcgctgcga

SEQ ID NO: 838414 - DNA, 20 bp, mouse
ggaaccttcatcgacgaggt

SEQ ID NO: 838415 - DNA, 20 bp, mouse
gcagtccagggcgggacgag

SEQ ID NO: 838416 - DNA, 20 bp, mouse
ggggaagaccagttgagggg

SEQ ID NO: 838417 - DNA, 20 bp, mouse
gggacctgcattagtacttc

SEQ ID NO: 838418 - DNA, 20 bp, mouse
gaaagctgcggcttaagggg

SEQ ID NO: 838419 - DNA, 20 bp, mouse
gaggggcggccgagccaagc

SEQ ID NO: 838420 - DNA, 20 bp, mouse
gagggggaagaccagttgag

SEQ ID NO: 838421 - DNA, 20 bp, mouse
gccctccttagcaacagcgt

SEQ ID NO: 838422 - DNA, 20 bp, mouse
gcaaccccacgctgttgcta

SEQ ID NO: 838423 - DNA, 20 bp, mouse
gagaagcagtaggcgcctcg

SEQ ID NO: 838424 - DNA, 20 bp, mouse
gacagcgtggggttgctaag

SEQ ID NO: 838425 - DNA, 20 bp, mouse
gaagccggaagtactaatgc

SEQ ID NO: 838426 - DNA, 20 bp, mouse
gccaccctgcagcttggctc

SEQ ID NO: 838427 - DNA, 20 bp, mouse
gggaagggagagaaccgtga

SEQ ID NO: 838428 - DNA, 20 bp, mouse
gcctccggagccaagctgca

SEQ ID NO: 838429 - DNA, 20 bp, mouse
gaggctgccacgtgcaagac

SEQ ID NO: 838430 - DNA, 20 bp, mouse
gagggcggtcttctcttaac

SEQ ID NO: 838431 - DNA, 20 bp, mouse
gaggtgagaggcagccgggt

SEQ ID NO: 838432 - DNA, 20 bp, mouse
gcggtcttctcttaacagga

SEQ ID NO: 838433 - DNA, 20 bp, mouse
gcgtggcagcctctcggccc

SEQ ID NO: 838434 - DNA, 20 bp, mouse
gggggaaggattgtagaata

SEQ ID NO: 838435 - DNA, 20 bp, mouse
gggctgcaggccgctctgag

SEQ ID NO: 838436 - DNA, 20 bp, mouse
gaggaagtactgaagctcta

SEQ ID NO: 838437 - DNA, 20 bp, mouse
gcaggagggccagacgagga

SEQ ID NO: 838438 - DNA, 20 bp, mouse
gtcctggaggctcgcaggga

SEQ ID NO: 838439 - DNA, 20 bp, mouse
gaaggagcaggacttagggt

SEQ ID NO: 838440 - DNA, 20 bp, mouse
gcaatcagagtgtagactga

SEQ ID NO: 838441 - DNA, 20 bp, mouse
gctgttaatgtctgcatcct

SEQ ID NO: 838442 - DNA, 20 bp, mouse
gactccaggagggccagacg

SEQ ID NO: 838443 - DNA, 20 bp, mouse
gctctaaggtgtagaaatga

SEQ ID NO: 838444 - DNA, 20 bp, mouse
ggcacacccctactccagga

SEQ ID NO: 838445 - DNA, 20 bp, mouse
gaaaactaagttcccgaaac

SEQ ID NO: 838446 - DNA, 20 bp, mouse
gtcgaaggcagttacgtcat

SEQ ID NO: 838447 - DNA, 20 bp, mouse
ggatctccggctcagaacgc

SEQ ID NO: 838448 - DNA, 20 bp, mouse
ggctaatctcagctagtcga

SEQ ID NO: 838449 - DNA, 20 bp, mouse
ggccatggggacagctgctt

SEQ ID NO: 838450 - DNA, 20 bp, mouse
gcaaaggtaccaagcttagg

SEQ ID NO: 838451 - DNA, 20 bp, mouse
ggtgcgccggcgcggatctc

SEQ ID NO: 838452 - DNA, 20 bp, mouse
gggacaaaggtaccaagctt

SEQ ID NO: 838453 - DNA, 20 bp, mouse
gggtggaaaggaggaaactg

SEQ ID NO: 838454 - DNA, 20 bp, mouse
gggaggaaactgtgggacaa

SEQ ID NO: 838455 - DNA, 20 bp, mouse
gctttgagaaagcaagtcgg

SEQ ID NO: 838456 - DNA, 20 bp, mouse
gcagggtcaagactcttcta

SEQ ID NO: 838457 - DNA, 20 bp, mouse
gaattcagggcaaaaagcgg

SEQ ID NO: 838458 - DNA, 20 bp, mouse
gtctagggaaggaagtgcgc

SEQ ID NO: 838459 - DNA, 20 bp, mouse
ggaccctggtcgcccactgt

SEQ ID NO: 838460 - DNA, 20 bp, mouse
gtcagtcccaccacgtactc

SEQ ID NO: 838461 - DNA, 20 bp, mouse
ggcaccttgtaggttaactc

SEQ ID NO: 838462 - DNA, 20 bp, mouse
ggtcaagactcttctaggga

SEQ ID NO: 838463 - DNA, 20 bp, mouse
gtcttctgtgtgcaccttgt

SEQ ID NO: 838464 - DNA, 20 bp, mouse
ggagcctgagttaacctaca

SEQ ID NO: 838465 - DNA, 20 bp, mouse
gagtttcactagtttaattc

SEQ ID NO: 838466 - DNA, 20 bp, mouse
gcacaggcctgtgtaagctc

SEQ ID NO: 838467 - DNA, 20 bp, mouse
ggggccggtggggaacgccg

SEQ ID NO: 838468 - DNA, 20 bp, mouse
gtgtgtaagctcgggtctcg

SEQ ID NO: 838469 - DNA, 20 bp, mouse
gcacttacggcttacgtcat

SEQ ID NO: 838470 - DNA, 20 bp, mouse
gcgcccggttacggcactta

SEQ ID NO: 838471 - DNA, 20 bp, mouse
gaactccaaaccggagaaag

SEQ ID NO: 838472 - DNA, 20 bp, mouse
ggcaccccggcgttccccac

SEQ ID NO: 838473 - DNA, 20 bp, mouse
gcccagaccccgccccctac

SEQ ID NO: 838474 - DNA, 20 bp, mouse
gctggaagacggcacgtgag

SEQ ID NO: 838475 - DNA, 20 bp, mouse
ggactgcgctaactccaaac

SEQ ID NO: 838476 - DNA, 20 bp, mouse
gagctcaaacaggtgactag

SEQ ID NO: 838477 - DNA, 20 bp, mouse
gtggctgggcttctatactc

SEQ ID NO: 838478 - DNA, 20 bp, mouse
gaccaaaaagacaaagtagg

SEQ ID NO: 838479 - DNA, 20 bp, mouse
gctagatgataccagtagat

SEQ ID NO: 838480 - DNA, 20 bp, mouse
gctgaccaaaaagacaaagt

SEQ ID NO: 838481 - DNA, 20 bp, mouse
ggagctatgtaaggtttacg

SEQ ID NO: 838482 - DNA, 20 bp, mouse
gcatagtccctgctggttga

SEQ ID NO: 838483 - DNA, 20 bp, mouse
gtagcaggcaaagagtctag

SEQ ID NO: 838484 - DNA, 20 bp, mouse
gggtttcccttcaaccagca

SEQ ID NO: 838485 - DNA, 20 bp, mouse
gggggcccttaagattccct

SEQ ID NO: 838486 - DNA, 20 bp, mouse
ggccgcggcggaaaccctcg

SEQ ID NO: 838487 - DNA, 20 bp, mouse
ggactcaggggcagtcggcg

SEQ ID NO: 838488 - DNA, 20 bp, mouse
ggactcaaaacgtcattttc

SEQ ID NO: 838489 - DNA, 20 bp, mouse
gagcgactttaggcgcggtg

SEQ ID NO: 838490 - DNA, 20 bp, mouse
gggcctgcactgcaccgcga

SEQ ID NO: 838491 - DNA, 20 bp, mouse
gcagccgccggccgcagtct

SEQ ID NO: 838492 - DNA, 20 bp, mouse
gcggcagagagaagctccgc

SEQ ID NO: 838493 - DNA, 20 bp, mouse
gaaccctcgcggtgcagtgc

SEQ ID NO: 838494 - DNA, 20 bp, mouse
ggtacccagactgcggccgg

SEQ ID NO: 838495 - DNA, 20 bp, mouse
gtgtcccgcccctccggcca

SEQ ID NO: 838496 - DNA, 20 bp, mouse
gtcacaaggggagcgtgcta

SEQ ID NO: 838497 - DNA, 20 bp, mouse
gctggtgttcccaccgtctg

SEQ ID NO: 838498 - DNA, 20 bp, mouse
gctagggtagccacagacgg

SEQ ID NO: 838499 - DNA, 20 bp, mouse
gtatccctggggaactgcgc

SEQ ID NO: 838500 - DNA, 20 bp, mouse
gtccaagtggagtatccctg

SEQ ID NO: 838501 - DNA, 20 bp, mouse
gaagggcaagagtgagatcc

SEQ ID NO: 838502 - DNA, 20 bp, mouse
gcggaaacttggctctaggg

SEQ ID NO: 838503 - DNA, 20 bp, mouse
ggatcccgcgcagttcccca

SEQ ID NO: 838504 - DNA, 20 bp, mouse
gtttctaggaaggggcgcta

SEQ ID NO: 838505 - DNA, 20 bp, mouse
gaaaacaatgcatctcacaa

SEQ ID NO: 838506 - DNA, 20 bp, mouse
gggcgggtatgctacagctg

SEQ ID NO: 838507 - DNA, 20 bp, mouse
gcgacgcggcggggctctca

SEQ ID NO: 838508 - DNA, 20 bp, mouse
gcccctctaagccggcgctg

SEQ ID NO: 838509 - DNA, 20 bp, mouse
ggagatcggaaggactgtgt

SEQ ID NO: 838510 - DNA, 20 bp, mouse
gggcggcagccgagatcgga

SEQ ID NO: 838511 - DNA, 20 bp, mouse
ggtaccggaagcgtttctcg

SEQ ID NO: 838512 - DNA, 20 bp, mouse
gtagccgcaaacagaggtcg

SEQ ID NO: 838513 - DNA, 20 bp, mouse
gacagaggtcggggatgatc

SEQ ID NO: 838514 - DNA, 20 bp, mouse
gggtccggcgaagagttcaa

SEQ ID NO: 838515 - DNA, 20 bp, mouse
gaagtcggccacttccggtc

SEQ ID NO: 838516 - DNA, 20 bp, mouse
ggaaatgagtcgatatcctc

SEQ ID NO: 838517 - DNA, 20 bp, mouse
gaatggaatttcgggtgcag

SEQ ID NO: 838518 - DNA, 20 bp, mouse
gcgaagtattactgcgatca

SEQ ID NO: 838519 - DNA, 20 bp, mouse
gagagagtgtataacgtttc

SEQ ID NO: 838520 - DNA, 20 bp, mouse
gtcgctccgctacggcgcat

SEQ ID NO: 838521 - DNA, 20 bp, mouse
gggtgcagtgggttgctttc

SEQ ID NO: 838522 - DNA, 20 bp, mouse
gataacaaaaatggctgccg

SEQ ID NO: 838523 - DNA, 20 bp, mouse
gagactaaccataacaaaaa

SEQ ID NO: 838524 - DNA, 20 bp, mouse
gtattactgcgatcagggaa

SEQ ID NO: 838525 - DNA, 20 bp, mouse
gtctgggaatcctggttgtc

SEQ ID NO: 838526 - DNA, 20 bp, mouse
ggagactatcactcgtgcca

SEQ ID NO: 838527 - DNA, 20 bp, mouse
gccctgctggggtttaaccc

SEQ ID NO: 838528 - DNA, 20 bp, mouse
gaagccaatctcggggacac

SEQ ID NO: 838529 - DNA, 20 bp, mouse
gggagtctgaagccaatctc

SEQ ID NO: 838530 - DNA, 20 bp, mouse
gcggctttgccttacttagt

SEQ ID NO: 838531 - DNA, 20 bp, mouse
ggcaaagccgctttgagatc

SEQ ID NO: 838532 - DNA, 20 bp, mouse
gaaatggcggcacaggcctc

SEQ ID NO: 838533 - DNA, 20 bp, mouse
gagagaaatgtaaacagtgt

SEQ ID NO: 838534 - DNA, 20 bp, mouse
gcagactcctgatctcaaag

SEQ ID NO: 838535 - DNA, 20 bp, mouse
gagcacatctgtgcgtgcct

SEQ ID NO: 838536 - DNA, 20 bp, mouse
ggggtgttgtagtcttattt

SEQ ID NO: 838537 - DNA, 20 bp, mouse
gaggcatcgcgcctcatggg

SEQ ID NO: 838538 - DNA, 20 bp, mouse
gggctcgtggagtgtgtggc

SEQ ID NO: 838539 - DNA, 20 bp, mouse
ggaactgagcaccgcccatg

SEQ ID NO: 838540 - DNA, 20 bp, mouse
gaggaggcatcgcgcctcat

SEQ ID NO: 838541 - DNA, 20 bp, mouse
gtgggtgtccgactggtccg

SEQ ID NO: 838542 - DNA, 20 bp, mouse
ggggctctgggaaggcgctt

SEQ ID NO: 838543 - DNA, 20 bp, mouse
gactgcgcagaagcgtgtgg

SEQ ID NO: 838544 - DNA, 20 bp, mouse
gggtacgtcctctgcatcac

SEQ ID NO: 838545 - DNA, 20 bp, mouse
gagaggacgtaccgaggaaa

SEQ ID NO: 838546 - DNA, 20 bp, mouse
gttcccgccgctggggtcag

SEQ ID NO: 838547 - DNA, 20 bp, mouse
gcccggccgcgcctcagccc

SEQ ID NO: 838548 - DNA, 20 bp, mouse
gcaggcggaagtgcgcgcgt

SEQ ID NO: 838549 - DNA, 20 bp, mouse
gccgctcacgccagcgtcgg

SEQ ID NO: 838550 - DNA, 20 bp, mouse
ggctgctggaaggatcagtc

SEQ ID NO: 838551 - DNA, 20 bp, mouse
gcttcccgccaaaacgcccg

SEQ ID NO: 838552 - DNA, 20 bp, mouse
gaagtgcgcgcgtgggtcgc

SEQ ID NO: 838553 - DNA, 20 bp, mouse
gtggggcagggcagccggag

SEQ ID NO: 838554 - DNA, 20 bp, mouse
gcgctccccgggctgaggcg

SEQ ID NO: 838555 - DNA, 20 bp, mouse
gggcgtgagcggctgctgga

SEQ ID NO: 838556 - DNA, 20 bp, mouse
gagactgggcagcacgtctg

SEQ ID NO: 838557 - DNA, 20 bp, mouse
ggataaggagaaaagagcgg

SEQ ID NO: 838558 - DNA, 20 bp, mouse
gtgggcagcacgtctgcggg

SEQ ID NO: 838559 - DNA, 20 bp, mouse
ggacgtgctgcccagtctgg

SEQ ID NO: 838560 - DNA, 20 bp, mouse
gaggaggagccccgcagcac

SEQ ID NO: 838561 - DNA, 20 bp, mouse
gagagcggcggatctcaaaa

SEQ ID NO: 838562 - DNA, 20 bp, mouse
gcaggtagagtccgccagac

SEQ ID NO: 838563 - DNA, 20 bp, mouse
ggcaggggccagtcacttcc

SEQ ID NO: 838564 - DNA, 20 bp, mouse
gcggatctcaaaaaggaact

SEQ ID NO: 838565 - DNA, 20 bp, mouse
gtagggatctggataagcca

SEQ ID NO: 838566 - DNA, 20 bp, mouse
ggcagtggatacagcctcct

SEQ ID NO: 838567 - DNA, 20 bp, mouse
ggcgtcccaggctccgccag

SEQ ID NO: 838568 - DNA, 20 bp, mouse
gcggaagcgcattgactcac

SEQ ID NO: 838569 - DNA, 20 bp, mouse
gagtcgttgaggaccccagg

SEQ ID NO: 838570 - DNA, 20 bp, mouse
gggaaataagagctcccaag

SEQ ID NO: 838571 - DNA, 20 bp, mouse
ggggcaatgcatggctataa

SEQ ID NO: 838572 - DNA, 20 bp, mouse
ggttgtacattcagtcgttg

SEQ ID NO: 838573 - DNA, 20 bp, mouse
gcgaatcggatgtaccgctt

SEQ ID NO: 838574 - DNA, 20 bp, mouse
ggggagttagagcctggacc

SEQ ID NO: 838575 - DNA, 20 bp, mouse
ggaaagccacacttatatga

SEQ ID NO: 838576 - DNA, 20 bp, mouse
gccggggcgcttggggttag

SEQ ID NO: 838577 - DNA, 20 bp, mouse
gcgcttggggttaggggaag

SEQ ID NO: 838578 - DNA, 20 bp, mouse
gcccaagcgccccggctgag

SEQ ID NO: 838579 - DNA, 20 bp, mouse
ggggcagagacgtaccagcc

SEQ ID NO: 838580 - DNA, 20 bp, mouse
gtcccggcacagcatccaag

SEQ ID NO: 838581 - DNA, 20 bp, mouse
gttgctacgagagcccggaa

SEQ ID NO: 838582 - DNA, 20 bp, mouse
gggctctcgtagcaaatcgc

SEQ ID NO: 838583 - DNA, 20 bp, mouse
gaagagaggtgcgagtccac

SEQ ID NO: 838584 - DNA, 20 bp, mouse
gcggtcgcggagcaccatgc

SEQ ID NO: 838585 - DNA, 20 bp, mouse
ggcttcagaggcggagctac

SEQ ID NO: 838586 - DNA, 20 bp, mouse
gtaaggaagccacgcgacta

SEQ ID NO: 838587 - DNA, 20 bp, mouse
gtccggagacggagtgtccg

SEQ ID NO: 838588 - DNA, 20 bp, mouse
gcgccagaacgccagacgca

SEQ ID NO: 838589 - DNA, 20 bp, mouse
gaagccacgcgactaggggg

SEQ ID NO: 838590 - DNA, 20 bp, mouse
gaagcggcgtgcagcacgtg

SEQ ID NO: 838591 - DNA, 20 bp, mouse
ggagcccggcacgaccagga

SEQ ID NO: 838592 - DNA, 20 bp, mouse
gtccgcggacactccgtctc

SEQ ID NO: 838593 - DNA, 20 bp, mouse
gtgagagtgtatacggctta

SEQ ID NO: 838594 - DNA, 20 bp, mouse
gtccggtccggacctcggga

SEQ ID NO: 838595 - DNA, 20 bp, mouse
gaggtccgagtttgccttct

SEQ ID NO: 838596 - DNA, 20 bp, mouse
gcggctgtgttcttctgtgc

SEQ ID NO: 838597 - DNA, 20 bp, mouse
gtgcaccgggcagccctaaa

SEQ ID NO: 838598 - DNA, 20 bp, mouse
ggacaggccgcgggcgagca

SEQ ID NO: 838599 - DNA, 20 bp, mouse
gtgtccgcgcgcggcctttt

SEQ ID NO: 838600 - DNA, 20 bp, mouse
ggcacgaagtgtctgcccgc

SEQ ID NO: 838601 - DNA, 20 bp, mouse
gaaagtcccctgctcgcccg

SEQ ID NO: 838602 - DNA, 20 bp, mouse
gcagccagaaaaggtcctct

SEQ ID NO: 838603 - DNA, 20 bp, mouse
gagggtcatgcgtatcccgc

SEQ ID NO: 838604 - DNA, 20 bp, mouse
gtttctggctggcgtctctt

SEQ ID NO: 838605 - DNA, 20 bp, mouse
gaaccaacgcagggctctct

SEQ ID NO: 838606 - DNA, 20 bp, mouse
ggacccgaccaactcatcgc

SEQ ID NO: 838607 - DNA, 20 bp, mouse
gtcggccgaggagcactagg

SEQ ID NO: 838608 - DNA, 20 bp, mouse
gagacctcaagcccgagcgg

SEQ ID NO: 838609 - DNA, 20 bp, mouse
gcgagtggtggctaagaagc

SEQ ID NO: 838610 - DNA, 20 bp, mouse
gacagaagaaaacgtcgcaa

SEQ ID NO: 838611 - DNA, 20 bp, mouse
gcccgagcggaggctgttcc

SEQ ID NO: 838612 - DNA, 20 bp, mouse
gcgtcccccccgtcccccgg

SEQ ID NO: 838613 - DNA, 20 bp, mouse
gaggccagcgatgagttggt

SEQ ID NO: 838614 - DNA, 20 bp, mouse
gcaaaagcctgcagaacact

SEQ ID NO: 838615 - DNA, 20 bp, mouse
gccgcgcggcggatcggccg

SEQ ID NO: 838616 - DNA, 20 bp, mouse
ggctctgaagagggtctctg

SEQ ID NO: 838617 - DNA, 20 bp, mouse
gctggcaccggctctgaaga

SEQ ID NO: 838618 - DNA, 20 bp, mouse
gtgaagagggtctctgtggg

SEQ ID NO: 838619 - DNA, 20 bp, mouse
gaggggcgtggcctcggctg

SEQ ID NO: 838620 - DNA, 20 bp, mouse
ggcctcggctggggcacagt

SEQ ID NO: 838621 - DNA, 20 bp, mouse
ggagtggctccacgggatag

SEQ ID NO: 838622 - DNA, 20 bp, mouse
ggcggaggataagcttccga

SEQ ID NO: 838623 - DNA, 20 bp, mouse
gaacccctctgggagcgcgg

SEQ ID NO: 838624 - DNA, 20 bp, mouse
ggaagcggcggacaggtcgg

SEQ ID NO: 838625 - DNA, 20 bp, mouse
gaggccacgcccctatcccg

SEQ ID NO: 838626 - DNA, 20 bp, mouse
ggggcatcatcccaaatttg

SEQ ID NO: 838627 - DNA, 20 bp, mouse
gtcccagattggctccgttt

SEQ ID NO: 838628 - DNA, 20 bp, mouse
gtgtcacgcgggcccggcag

SEQ ID NO: 838629 - DNA, 20 bp, mouse
gtgggcttatggggtggtta

SEQ ID NO: 838630 - DNA, 20 bp, mouse
gaggcacaaaagtctcggat

SEQ ID NO: 838631 - DNA, 20 bp, mouse
gtgcccaaacggagccaatc

SEQ ID NO: 838632 - DNA, 20 bp, mouse
ggccaatctgggagaaagac

SEQ ID NO: 838633 - DNA, 20 bp, mouse
gacccggagcgctaagttct

SEQ ID NO: 838634 - DNA, 20 bp, mouse
gggtgacgcccagccattct

SEQ ID NO: 838635 - DNA, 20 bp, mouse
gcgctccttggcgggaggca

SEQ ID NO: 838636 - DNA, 20 bp, mouse
gtagccccgcccagaggaag

SEQ ID NO: 838637 - DNA, 20 bp, mouse
ggggtcccacccacttcctc

SEQ ID NO: 838638 - DNA, 20 bp, mouse
gggggctaggctttactaag

SEQ ID NO: 838639 - DNA, 20 bp, mouse
gagtggcttctcattcgctg

SEQ ID NO: 838640 - DNA, 20 bp, mouse
gtgcgcgcatgacaggcagt

SEQ ID NO: 838641 - DNA, 20 bp, mouse
gtgtcttggtgcttgagatg

SEQ ID NO: 838642 - DNA, 20 bp, mouse
gcgacccggaagtgcgcgtg

SEQ ID NO: 838643 - DNA, 20 bp, mouse
gctgtcatgcgcgcaggcgc

SEQ ID NO: 838644 - DNA, 20 bp, mouse
ggggccgcacgcgcacttcc

SEQ ID NO: 838645 - DNA, 20 bp, mouse
gcgggcagcaggcgggtaag

SEQ ID NO: 838646 - DNA, 20 bp, mouse
gggaacagggacacgtattg

SEQ ID NO: 838647 - DNA, 20 bp, mouse
ggggaagccgttagcgggga

SEQ ID NO: 838648 - DNA, 20 bp, mouse
ggtgttgtcaggacaggcgt

SEQ ID NO: 838649 - DNA, 20 bp, mouse
ggagactgggaagccgttag

SEQ ID NO: 838650 - DNA, 20 bp, mouse
gcttcccagtctcctcagtg

SEQ ID NO: 838651 - DNA, 20 bp, mouse
gaaacagatgcgccacactg

SEQ ID NO: 838652 - DNA, 20 bp, mouse
ggacggagacccccctctgg

SEQ ID NO: 838653 - DNA, 20 bp, mouse
gggtgtgaatgctgaacaag

SEQ ID NO: 838654 - DNA, 20 bp, mouse
gagggacggagacccccctc

SEQ ID NO: 838655 - DNA, 20 bp, mouse
gtaattagtgttgtcaggac

SEQ ID NO: 838656 - DNA, 20 bp, mouse
gggagcgcgagtggcaggat

SEQ ID NO: 838657 - DNA, 20 bp, mouse
gtcgcgctccgtcctcggat

SEQ ID NO: 838658 - DNA, 20 bp, mouse
gaagcccgggaaggccagtc

SEQ ID NO: 838659 - DNA, 20 bp, mouse
ggccactcgcgctccgtcct

SEQ ID NO: 838660 - DNA, 20 bp, mouse
ggagagctggagccaaccga

SEQ ID NO: 838661 - DNA, 20 bp, mouse
gccgaaggcggggccagaga

SEQ ID NO: 838662 - DNA, 20 bp, mouse
gacggagccacccaatccgc

SEQ ID NO: 838663 - DNA, 20 bp, mouse
gagctctctcggccaatccg

SEQ ID NO: 838664 - DNA, 20 bp, mouse
gtggtcaacagtggtctcga

SEQ ID NO: 838665 - DNA, 20 bp, mouse
gaatccgcaggctccgaagg

SEQ ID NO: 838666 - DNA, 20 bp, mouse
gaagtaggcggggtgacgtg

SEQ ID NO: 838667 - DNA, 20 bp, mouse
gtacttctccggcccggcag

SEQ ID NO: 838668 - DNA, 20 bp, mouse
gctggggcggggcgatggaa

SEQ ID NO: 838669 - DNA, 20 bp, mouse
ggggcgctacggatcctgag

SEQ ID NO: 838670 - DNA, 20 bp, mouse
gcccagctctggggtgccaa

SEQ ID NO: 838671 - DNA, 20 bp, mouse
gcggagaagtagcggggcct

SEQ ID NO: 838672 - DNA, 20 bp, mouse
gagagcgcgaggtggaagcg

SEQ ID NO: 838673 - DNA, 20 bp, mouse
gccgggccggagaagtagcg

SEQ ID NO: 838674 - DNA, 20 bp, mouse
gcgtcggagaagtgacttca

SEQ ID NO: 838675 - DNA, 20 bp, mouse
ggaggctgtcgggaagtagg

SEQ ID NO: 838676 - DNA, 20 bp, mouse
gctgctgagggcaacatctc

SEQ ID NO: 838677 - DNA, 20 bp, mouse
gaggcaggagtcctccgaat

SEQ ID NO: 838678 - DNA, 20 bp, mouse
gtaagggcaagtccttccgt

SEQ ID NO: 838679 - DNA, 20 bp, mouse
gtgggtggaaaccgattcgg

SEQ ID NO: 838680 - DNA, 20 bp, mouse
gctaagatatagagctgtga

SEQ ID NO: 838681 - DNA, 20 bp, mouse
gggttgagggcaagaaatgg

SEQ ID NO: 838682 - DNA, 20 bp, mouse
gcaagtccttccgtgggttg

SEQ ID NO: 838683 - DNA, 20 bp, mouse
gttagccagggtgagcacgt

SEQ ID NO: 838684 - DNA, 20 bp, mouse
gccagggtgagcacgtggga

SEQ ID NO: 838685 - DNA, 20 bp, mouse
ggagactcctggcacaaagc

SEQ ID NO: 838686 - DNA, 20 bp, mouse
gcgtaagaaaaggaacacgg

SEQ ID NO: 838687 - DNA, 20 bp, mouse
gaaccgaagggacattaaga

SEQ ID NO: 838688 - DNA, 20 bp, mouse
gaaatcctatggatgatagg

SEQ ID NO: 838689 - DNA, 20 bp, mouse
gtccacggaagtcagtgaag

SEQ ID NO: 838690 - DNA, 20 bp, mouse
gaggaaatcctatggatgat

SEQ ID NO: 838691 - DNA, 20 bp, mouse
ggccccttcactgacttccg

SEQ ID NO: 838692 - DNA, 20 bp, mouse
ggctggctgtattaggggga

SEQ ID NO: 838693 - DNA, 20 bp, mouse
gctgtcatgctggctgtatt

SEQ ID NO: 838694 - DNA, 20 bp, mouse
gccgcccccagcgtaagaaa

SEQ ID NO: 838695 - DNA, 20 bp, mouse
gactcactactcacacttga

SEQ ID NO: 838696 - DNA, 20 bp, mouse
gggaacctttgctccgaggg

SEQ ID NO: 838697 - DNA, 20 bp, mouse
gagcgccaaccgggcggcga

SEQ ID NO: 838698 - DNA, 20 bp, mouse
gcgccccaaggcttgaggta

SEQ ID NO: 838699 - DNA, 20 bp, mouse
gggaaccgccaaggaggtga

SEQ ID NO: 838700 - DNA, 20 bp, mouse
gcccaaggcttgaggtaagg

SEQ ID NO: 838701 - DNA, 20 bp, mouse
gaggtgagggacacagccct

SEQ ID NO: 838702 - DNA, 20 bp, mouse
gctccgagggaggaagatgc

SEQ ID NO: 838703 - DNA, 20 bp, mouse
ggctgggggcggtgccagag

SEQ ID NO: 838704 - DNA, 20 bp, mouse
gcgcgggcggggcttcgtgg

SEQ ID NO: 838705 - DNA, 20 bp, mouse
ggcgcatgcgcagatgctgg

SEQ ID NO: 838706 - DNA, 20 bp, mouse
ggatccccctagccaagcga

SEQ ID NO: 838707 - DNA, 20 bp, mouse
gtggccggggcgggcacaga

SEQ ID NO: 838708 - DNA, 20 bp, mouse
ggggagacccagagctgaaa

SEQ ID NO: 838709 - DNA, 20 bp, mouse
gggggcgggcacagaggggt

SEQ ID NO: 838710 - DNA, 20 bp, mouse
gagggtgcgccctccgcagg

SEQ ID NO: 838711 - DNA, 20 bp, mouse
gcccgccccggccacctcgg

SEQ ID NO: 838712 - DNA, 20 bp, mouse
ggcgaggcagcccagcgcgt

SEQ ID NO: 838713 - DNA, 20 bp, mouse
gaggccctccgtttcagctc

SEQ ID NO: 838714 - DNA, 20 bp, mouse
gagacccagagctgaaacgg

SEQ ID NO: 838715 - DNA, 20 bp, mouse
gaaagtcctgggtggcacag

SEQ ID NO: 838716 - DNA, 20 bp, mouse
gcgcgcgcccacgtagaccg

SEQ ID NO: 838717 - DNA, 20 bp, mouse
ggggttcaggacgcgtgcgc

SEQ ID NO: 838718 - DNA, 20 bp, mouse
gcgcgagccgcggtctacgt

SEQ ID NO: 838719 - DNA, 20 bp, mouse
gaaggaccgggtgacccagg

SEQ ID NO: 838720 - DNA, 20 bp, mouse
gcgtgcgccggcctggaggc

SEQ ID NO: 838721 - DNA, 20 bp, mouse
gcccctgcccgcctccaggc

SEQ ID NO: 838722 - DNA, 20 bp, mouse
ggatggtcgcacaaacgctc

SEQ ID NO: 838723 - DNA, 20 bp, mouse
ggggggcgggcctggcggta

SEQ ID NO: 838724 - DNA, 20 bp, mouse
ggccgggcgaggagggagca

SEQ ID NO: 838725 - DNA, 20 bp, mouse
gcgcgagcggcgcggggtcg

SEQ ID NO: 838726 - DNA, 20 bp, mouse
gcgggagccggagaacactc

SEQ ID NO: 838727 - DNA, 20 bp, mouse
gccgacccccggagccgctt

SEQ ID NO: 838728 - DNA, 20 bp, mouse
gaacactccgggtgagcggg

SEQ ID NO: 838729 - DNA, 20 bp, mouse
gtccggggccgccctgcgag

SEQ ID NO: 838730 - DNA, 20 bp, mouse
gcagccgcaggccgaccaat

SEQ ID NO: 838731 - DNA, 20 bp, mouse
gcccggggcagaaacaagcc

SEQ ID NO: 838732 - DNA, 20 bp, mouse
gtcccaccacggccagtccc

SEQ ID NO: 838733 - DNA, 20 bp, mouse
gaggagaagagcccgacccc

SEQ ID NO: 838734 - DNA, 20 bp, mouse
gcgaccaatcggctgcgcgg

SEQ ID NO: 838735 - DNA, 20 bp, mouse
gacaagcccgggcaacaaag

SEQ ID NO: 838736 - DNA, 20 bp, mouse
gagacggcggggctcccgaa

SEQ ID NO: 838737 - DNA, 20 bp, mouse
ggtcacctccactcagacag

SEQ ID NO: 838738 - DNA, 20 bp, mouse
gcgggacggcagccaatcac

SEQ ID NO: 838739 - DNA, 20 bp, mouse
gcccctccgcggtttgccag

SEQ ID NO: 838740 - DNA, 20 bp, mouse
gggagcctctgtctgagtgg

SEQ ID NO: 838741 - DNA, 20 bp, mouse
gacccgctggcaaaccgcgg

SEQ ID NO: 838742 - DNA, 20 bp, mouse
ggggacgggccgagagacgg

SEQ ID NO: 838743 - DNA, 20 bp, mouse
gcagcgaggtgggattcttg

SEQ ID NO: 838744 - DNA, 20 bp, mouse
ggcgtcagcggccgtcggga

SEQ ID NO: 838745 - DNA, 20 bp, mouse
gccgggctacagccacccgc

SEQ ID NO: 838746 - DNA, 20 bp, mouse
gagcgcacacggatacagac

SEQ ID NO: 838747 - DNA, 20 bp, mouse
ggtgggagcggtgttcatgg

SEQ ID NO: 838748 - DNA, 20 bp, mouse
gagacaggaaccaagtctac

SEQ ID NO: 838749 - DNA, 20 bp, mouse
gtggcccttccctgtagact

SEQ ID NO: 838750 - DNA, 20 bp, mouse
ggctctctcaggaaactcgt

SEQ ID NO: 838751 - DNA, 20 bp, mouse
gggaactcaaagggatggtg

SEQ ID NO: 838752 - DNA, 20 bp, mouse
gggaaccaagtctacaggga

SEQ ID NO: 838753 - DNA, 20 bp, mouse
gaaaagttgccgagcgcaca

SEQ ID NO: 838754 - DNA, 20 bp, mouse
ggtgaagtgtgttgtgggag

SEQ ID NO: 838755 - DNA, 20 bp, mouse
gtggtgtgggctgctgacat

SEQ ID NO: 838756 - DNA, 20 bp, mouse
gtcactgaaaggtttgaacc

SEQ ID NO: 838757 - DNA, 20 bp, mouse
gcagagaataggagatagtt

SEQ ID NO: 838758 - DNA, 20 bp, mouse
gcagcccatatggccctgca

SEQ ID NO: 838759 - DNA, 20 bp, mouse
gtatgggctgatgaagtttt

SEQ ID NO: 838760 - DNA, 20 bp, mouse
gttagaaatctactgtgcaa

SEQ ID NO: 838761 - DNA, 20 bp, mouse
gcagtagatttctaaggcaa

SEQ ID NO: 838762 - DNA, 20 bp, mouse
ggtacagtgatgaacagggt

SEQ ID NO: 838763 - DNA, 20 bp, mouse
gtaccatagagacggctgtg

SEQ ID NO: 838764 - DNA, 20 bp, mouse
gcctagtacagtgatgaaca

SEQ ID NO: 838765 - DNA, 20 bp, mouse
ggatctataagagttgcagg

SEQ ID NO: 838766 - DNA, 20 bp, mouse
gtgtggagaagctcagtatg

SEQ ID NO: 838767 - DNA, 20 bp, mouse
ggagaagctcagtatgaggc

SEQ ID NO: 838768 - DNA, 20 bp, mouse
gaagctcagtatgaggcagg

SEQ ID NO: 838769 - DNA, 20 bp, mouse
gactgtgtctccaggggtaa

SEQ ID NO: 838770 - DNA, 20 bp, mouse
gaaaaggccacacccatctg

SEQ ID NO: 838771 - DNA, 20 bp, mouse
gtaaagggtgaaggggcaaa

SEQ ID NO: 838772 - DNA, 20 bp, mouse
gtccctataagataagaaga

SEQ ID NO: 838773 - DNA, 20 bp, mouse
gagagctgagaacatgatgt

SEQ ID NO: 838774 - DNA, 20 bp, mouse
gtccatcttcttatcttata

SEQ ID NO: 838775 - DNA, 20 bp, mouse
gaggtgccagtcaacatatg

SEQ ID NO: 838776 - DNA, 20 bp, mouse
ggagcccaggtggaagttga

SEQ ID NO: 838777 - DNA, 20 bp, mouse
ggggagaggcctcactccat

SEQ ID NO: 838778 - DNA, 20 bp, mouse
gcaactataggcatgagggg

SEQ ID NO: 838779 - DNA, 20 bp, mouse
gcattggagtggaggagccc

SEQ ID NO: 838780 - DNA, 20 bp, mouse
gaggcctcactccattggag

SEQ ID NO: 838781 - DNA, 20 bp, mouse
gggaagttgatggattggac

SEQ ID NO: 838782 - DNA, 20 bp, mouse
gtacccaactataggcatga

SEQ ID NO: 838783 - DNA, 20 bp, mouse
gaatccatcaacttccacct

SEQ ID NO: 838784 - DNA, 20 bp, mouse
gtcccttctgtgtgtctggt

SEQ ID NO: 838785 - DNA, 20 bp, mouse
gggggtggtaggtttgtttg

SEQ ID NO: 838786 - DNA, 20 bp, mouse
ggggcccgcaagctggtagc

SEQ ID NO: 838787 - DNA, 20 bp, mouse
gggaggaggagaccccgctg

SEQ ID NO: 838788 - DNA, 20 bp, mouse
ggccggccctcctcccgcca

SEQ ID NO: 838789 - DNA, 20 bp, mouse
gcccgcttcgaccaagactc

SEQ ID NO: 838790 - DNA, 20 bp, mouse
gactcgggcagagccagctg

SEQ ID NO: 838791 - DNA, 20 bp, mouse
ggacgcgcgccaagcggcgg

SEQ ID NO: 838792 - DNA, 20 bp, mouse
gggggcgcgcgtgggagcca

SEQ ID NO: 838793 - DNA, 20 bp, mouse
gggggcccagaccccgactc

SEQ ID NO: 838794 - DNA, 20 bp, mouse
gcagcgcgggcactcagccg

SEQ ID NO: 838795 - DNA, 20 bp, mouse
ggctggctctgcccgagtcg

SEQ ID NO: 838796 - DNA, 20 bp, mouse
ggggatgcagggtcagtggc

SEQ ID NO: 838797 - DNA, 20 bp, mouse
gactcagggaaggctccgga

SEQ ID NO: 838798 - DNA, 20 bp, mouse
gagcttagaagggtccgagt

SEQ ID NO: 838799 - DNA, 20 bp, mouse
gccctgagtggcagcttaga

SEQ ID NO: 838800 - DNA, 20 bp, mouse
gggaaggctccggagggctg

SEQ ID NO: 838801 - DNA, 20 bp, mouse
gctgggttgggtcaccctga

SEQ ID NO: 838802 - DNA, 20 bp, mouse
gtctctcccctgggtcgcca

SEQ ID NO: 838803 - DNA, 20 bp, mouse
ggacccaacccagactgcaa

SEQ ID NO: 838804 - DNA, 20 bp, mouse
ggtgcggtccaacacatctc

SEQ ID NO: 838805 - DNA, 20 bp, mouse
gagcttgcccggagatgtgt

SEQ ID NO: 838806 - DNA, 20 bp, mouse
gcctccctggccactatgag

SEQ ID NO: 838807 - DNA, 20 bp, mouse
gtccctaaaggggagagtct

SEQ ID NO: 838808 - DNA, 20 bp, mouse
gaagagagaaaggtcggggt

SEQ ID NO: 838809 - DNA, 20 bp, mouse
gggacaagagagaaaggtcg

SEQ ID NO: 838810 - DNA, 20 bp, mouse
gacagagcaattgcaaattg

SEQ ID NO: 838811 - DNA, 20 bp, mouse
gaggagtggacaagagagaa

SEQ ID NO: 838812 - DNA, 20 bp, mouse
gacaacccctcatagtggcc

SEQ ID NO: 838813 - DNA, 20 bp, mouse
gccccagactctccccttta

SEQ ID NO: 838814 - DNA, 20 bp, mouse
ggtagaggaagtagcaggcg

SEQ ID NO: 838815 - DNA, 20 bp, mouse
gggtgcgcaggacttcctga

SEQ ID NO: 838816 - DNA, 20 bp, mouse
gcagacgcgcccaagatgct

SEQ ID NO: 838817 - DNA, 20 bp, mouse
ggtcggtcgcctagcatctt

SEQ ID NO: 838818 - DNA, 20 bp, mouse
gctaggggcggggcttgtag

SEQ ID NO: 838819 - DNA, 20 bp, mouse
gaagcggttcccatgccctc

SEQ ID NO: 838820 - DNA, 20 bp, mouse
gcagagaggcgcgtcagccc

SEQ ID NO: 838821 - DNA, 20 bp, mouse
ggctgacgcgcctctctggt

SEQ ID NO: 838822 - DNA, 20 bp, mouse
ggctaggcgaccgaccagag

SEQ ID NO: 838823 - DNA, 20 bp, mouse
ggggcatgggaaccgcttgg

SEQ ID NO: 838824 - DNA, 20 bp, mouse
gcccgcggaggcgacgacac

SEQ ID NO: 838825 - DNA, 20 bp, mouse
gcatgggaaccgcttggtgg

SEQ ID NO: 838826 - DNA, 20 bp, mouse
gctgggcggagcagcaagac

SEQ ID NO: 838827 - DNA, 20 bp, mouse
gggcggagcagcaagaccgg

SEQ ID NO: 838828 - DNA, 20 bp, mouse
gtcgcgacactccctcgctt

SEQ ID NO: 838829 - DNA, 20 bp, mouse
gttcagcaggagagcgttct

SEQ ID NO: 838830 - DNA, 20 bp, mouse
ggctacaagcgcttgagcgg

SEQ ID NO: 838831 - DNA, 20 bp, mouse
gagaccggcggatgcctgtg

SEQ ID NO: 838832 - DNA, 20 bp, mouse
gcccaggccgcgcctccgat

SEQ ID NO: 838833 - DNA, 20 bp, mouse
gatggcaccagtccgcactg

SEQ ID NO: 838834 - DNA, 20 bp, mouse
gctgctcgtgtcctaagcga

SEQ ID NO: 838835 - DNA, 20 bp, mouse
gtgctccttcggaattaaga

SEQ ID NO: 838836 - DNA, 20 bp, mouse
gggtctctggtaaaaaagga

SEQ ID NO: 838837 - DNA, 20 bp, mouse
gtcagacaaaccagcaggtg

SEQ ID NO: 838838 - DNA, 20 bp, mouse
gcatgagggttctgggtctc

SEQ ID NO: 838839 - DNA, 20 bp, mouse
gtgcacagcgctgtctgcga

SEQ ID NO: 838840 - DNA, 20 bp, mouse
gtctgggtctctggtaaaaa

SEQ ID NO: 838841 - DNA, 20 bp, mouse
ggacacaagtgtcctaggaa

SEQ ID NO: 838842 - DNA, 20 bp, mouse
gctgtagacacaagtgtcct

SEQ ID NO: 838843 - DNA, 20 bp, mouse
gctctggtaaaaaaggaggg

SEQ ID NO: 838844 - DNA, 20 bp, mouse
gaggaatcagacaaaccagc

SEQ ID NO: 838845 - DNA, 20 bp, mouse
gaaccgcacttaaacccctg

SEQ ID NO: 838846 - DNA, 20 bp, mouse
gcattcgggcagacccagga

SEQ ID NO: 838847 - DNA, 20 bp, mouse
ggaccgcccccacccatcct

SEQ ID NO: 838848 - DNA, 20 bp, mouse
gtggccaaagagcagcctgg

SEQ ID NO: 838849 - DNA, 20 bp, mouse
gcagctggcacagaactggg

SEQ ID NO: 838850 - DNA, 20 bp, mouse
gggcagacccaggatgggtg

SEQ ID NO: 838851 - DNA, 20 bp, mouse
gtggggagagcatcagtgcc

SEQ ID NO: 838852 - DNA, 20 bp, mouse
gcatccattcgggcagaccc

SEQ ID NO: 838853 - DNA, 20 bp, mouse
gagccagagcaggggcgcgg

SEQ ID NO: 838854 - DNA, 20 bp, mouse
gtgggcgaggctgtcgtcct

SEQ ID NO: 838855 - DNA, 20 bp, mouse
gatactaagcagctggtcaa

SEQ ID NO: 838856 - DNA, 20 bp, mouse
gtcccactcagcaaactgga

SEQ ID NO: 838857 - DNA, 20 bp, mouse
gcctccgcgtcagtccacta

SEQ ID NO: 838858 - DNA, 20 bp, mouse
gtcagctacctgctccccct

SEQ ID NO: 838859 - DNA, 20 bp, mouse
gaggtgcaagccgcgtggca

SEQ ID NO: 838860 - DNA, 20 bp, mouse
gacgcacagtccctgccacg

SEQ ID NO: 838861 - DNA, 20 bp, mouse
gggaactgtagtctttaccg

SEQ ID NO: 838862 - DNA, 20 bp, mouse
gtgcgtgccccgacgcctta

SEQ ID NO: 838863 - DNA, 20 bp, mouse
ggccctccagtttgctgagt

SEQ ID NO: 838864 - DNA, 20 bp, mouse
gagggcctagaatttttccc

SEQ ID NO: 838865 - DNA, 20 bp, mouse
gtacagttcccataaggcgt

SEQ ID NO: 838866 - DNA, 20 bp, mouse
gggagagaaaagcataagag

SEQ ID NO: 838867 - DNA, 20 bp, mouse
ggaaaagcataagaggggtg

SEQ ID NO: 838868 - DNA, 20 bp, mouse
gagaacctgcagcagataga

SEQ ID NO: 838869 - DNA, 20 bp, mouse
gaaaaccctataccagccaa

SEQ ID NO: 838870 - DNA, 20 bp, mouse
gtggggaaccgcattcacac

SEQ ID NO: 838871 - DNA, 20 bp, mouse
gcgtgtatgtgaagggtctc

SEQ ID NO: 838872 - DNA, 20 bp, mouse
gaagatgagtgcgtgtggag

SEQ ID NO: 838873 - DNA, 20 bp, mouse
gaccccccaaaagatagaaa

SEQ ID NO: 838874 - DNA, 20 bp, mouse
gtctccccttggctggtata

SEQ ID NO: 838875 - DNA, 20 bp, mouse
gctcaagctaggtagctgat

SEQ ID NO: 838876 - DNA, 20 bp, mouse
gggaagaaggcgggaggcga

SEQ ID NO: 838877 - DNA, 20 bp, mouse
gaaggtggggatcgtgacgg

SEQ ID NO: 838878 - DNA, 20 bp, mouse
gggcgagggctggagagtca

SEQ ID NO: 838879 - DNA, 20 bp, mouse
gttaaaggtggggatcgtga

SEQ ID NO: 838880 - DNA, 20 bp, mouse
gggcacaggcggggcctcag

SEQ ID NO: 838881 - DNA, 20 bp, mouse
gggatcgtgacggaggacgt

SEQ ID NO: 838882 - DNA, 20 bp, mouse
ggtggcttccagacaggggt

SEQ ID NO: 838883 - DNA, 20 bp, mouse
ggcttccagacaggggtcgg

SEQ ID NO: 838884 - DNA, 20 bp, mouse
ggggtcggcggatttctgga

SEQ ID NO: 838885 - DNA, 20 bp, mouse
ggcctcagtggcagccgcta

SEQ ID NO: 838886 - DNA, 20 bp, mouse
gcaagtgaaaagtggggaat

SEQ ID NO: 838887 - DNA, 20 bp, mouse
ggggcatgaagaaatcctga

SEQ ID NO: 838888 - DNA, 20 bp, mouse
gggtgttatgcactattcta

SEQ ID NO: 838889 - DNA, 20 bp, mouse
gtcaaagctacgtctggaag

SEQ ID NO: 838890 - DNA, 20 bp, mouse
gctacgtctggaagaggggt

SEQ ID NO: 838891 - DNA, 20 bp, mouse
ggggctgatttcctacttgt

SEQ ID NO: 838892 - DNA, 20 bp, mouse
gtccagacgtagctttgaaa

SEQ ID NO: 838893 - DNA, 20 bp, mouse
gctaacagatcataaaacga

SEQ ID NO: 838894 - DNA, 20 bp, mouse
gtgcactattctagggggag

SEQ ID NO: 838895 - DNA, 20 bp, mouse
gagtttaaacaagtgaaaag

SEQ ID NO: 838896 - DNA, 20 bp, mouse
gagcacttggaacataggcc

SEQ ID NO: 838897 - DNA, 20 bp, mouse
gacctcttacggatctccac

SEQ ID NO: 838898 - DNA, 20 bp, mouse
gtgctctatgggagtgtttc

SEQ ID NO: 838899 - DNA, 20 bp, mouse
ggcgggacttccggcccaaa

SEQ ID NO: 838900 - DNA, 20 bp, mouse
ggatccacttccgggtggta

SEQ ID NO: 838901 - DNA, 20 bp, mouse
gaaaggggcgccagacaatt

SEQ ID NO: 838902 - DNA, 20 bp, mouse
gcctgggccaggaagacggg

SEQ ID NO: 838903 - DNA, 20 bp, mouse
gaacccctaccacccggaag

SEQ ID NO: 838904 - DNA, 20 bp, mouse
ggacttccggcccaaagggc

SEQ ID NO: 838905 - DNA, 20 bp, mouse
gcctggcccaggcttccaaa

SEQ ID NO: 838906 - DNA, 20 bp, mouse
gagaaagtggtgactgcaga

SEQ ID NO: 838907 - DNA, 20 bp, mouse
gcccccgcaaggtttttagg

SEQ ID NO: 838908 - DNA, 20 bp, mouse
ggtgcccaaggccccttgtt

SEQ ID NO: 838909 - DNA, 20 bp, mouse
gttggggtgggcacatgatg

SEQ ID NO: 838910 - DNA, 20 bp, mouse
ggggcacatgatgaggattt

SEQ ID NO: 838911 - DNA, 20 bp, mouse
ggactgcagagggtttgggg

SEQ ID NO: 838912 - DNA, 20 bp, mouse
gaggatttggggatccagca

SEQ ID NO: 838913 - DNA, 20 bp, mouse
gtgggtgggagtccagccgg

SEQ ID NO: 838914 - DNA, 20 bp, mouse
gactccacaaacactactgt

SEQ ID NO: 838915 - DNA, 20 bp, mouse
gccttgggcaccagtgctga

SEQ ID NO: 838916 - DNA, 20 bp, mouse
gcagactggggtggctggat

SEQ ID NO: 838917 - DNA, 20 bp, mouse
ggaagaggctgacccgcaag

SEQ ID NO: 838918 - DNA, 20 bp, mouse
gtgcgcctagcgatgagatg

SEQ ID NO: 838919 - DNA, 20 bp, mouse
gtggccaggcatgacttcct

SEQ ID NO: 838920 - DNA, 20 bp, mouse
ggtggagccaagcatgtgct

SEQ ID NO: 838921 - DNA, 20 bp, mouse
gcgcccctgttggacctgag

SEQ ID NO: 838922 - DNA, 20 bp, mouse
gcccgcaagtggagcatctc

SEQ ID NO: 838923 - DNA, 20 bp, mouse
gacacctagaaaggcacttg

SEQ ID NO: 838924 - DNA, 20 bp, mouse
gaggaggcccagcacatgct

SEQ ID NO: 838925 - DNA, 20 bp, mouse
gagtgcggggcgggccattc

SEQ ID NO: 838926 - DNA, 20 bp, mouse
gagggcctgaagactgggtg

SEQ ID NO: 838927 - DNA, 20 bp, mouse
gggttcacggcccacgcctg

SEQ ID NO: 838928 - DNA, 20 bp, mouse
ggctccacaaccccaggcgt

SEQ ID NO: 838929 - DNA, 20 bp, mouse
gattggctcaacaggggctg

SEQ ID NO: 838930 - DNA, 20 bp, mouse
ggtccccagggcctgaagac

SEQ ID NO: 838931 - DNA, 20 bp, mouse
gccctcccgcgccttgaagg

SEQ ID NO: 838932 - DNA, 20 bp, mouse
ggggtcacccactggtgagt

SEQ ID NO: 838933 - DNA, 20 bp, mouse
gctcgcgattggctcaacag

SEQ ID NO: 838934 - DNA, 20 bp, mouse
ggacccaggcttctgctccc

SEQ ID NO: 838935 - DNA, 20 bp, mouse
gtccccctcccgcgccttga

SEQ ID NO: 838936 - DNA, 20 bp, mouse
gagagcaagcggaggaacga

SEQ ID NO: 838937 - DNA, 20 bp, mouse
ggagtcccgggacacgtcac

SEQ ID NO: 838938 - DNA, 20 bp, mouse
gggcggggagagggcggctg

SEQ ID NO: 838939 - DNA, 20 bp, mouse
ggtcacgggaggcggggaga

SEQ ID NO: 838940 - DNA, 20 bp, mouse
gtcccgggacacgtcacggg

SEQ ID NO: 838941 - DNA, 20 bp, mouse
gcagtgatggggtcggtttg

SEQ ID NO: 838942 - DNA, 20 bp, mouse
gctgctgccaaaccagtgat

SEQ ID NO: 838943 - DNA, 20 bp, mouse
gagaaagaccgagagttgga

SEQ ID NO: 838944 - DNA, 20 bp, mouse
ggggacacgtcacgggaggc

SEQ ID NO: 838945 - DNA, 20 bp, mouse
ggggctgggctgcgaagttg

SEQ ID NO: 838946 - DNA, 20 bp, mouse
gccaccctgtggtctgtgta

SEQ ID NO: 838947 - DNA, 20 bp, mouse
gcacctcagtggggcctcct

SEQ ID NO: 838948 - DNA, 20 bp, mouse
gccaccttccagactcttct

SEQ ID NO: 838949 - DNA, 20 bp, mouse
gaaccaatgagaagcccagg

SEQ ID NO: 838950 - DNA, 20 bp, mouse
gaggctggaccgctgggcca

SEQ ID NO: 838951 - DNA, 20 bp, mouse
gggtccagacttcacctcag

SEQ ID NO: 838952 - DNA, 20 bp, mouse
gcctccctctgcctgagggg

SEQ ID NO: 838953 - DNA, 20 bp, mouse
ggctgggcctagagcgttat

SEQ ID NO: 838954 - DNA, 20 bp, mouse
gctgaggggtgggaactctg

SEQ ID NO: 838955 - DNA, 20 bp, mouse
gcacctggccagggctttct

SEQ ID NO: 838956 - DNA, 20 bp, mouse
ggggcctgacccctgttcat

SEQ ID NO: 838957 - DNA, 20 bp, mouse
ggagcactcagctgcaggtc

SEQ ID NO: 838958 - DNA, 20 bp, mouse
gagtgctctcctatgaacag

SEQ ID NO: 838959 - DNA, 20 bp, mouse
gaaagacagcgtccatgtgc

SEQ ID NO: 838960 - DNA, 20 bp, mouse
ggctccacccactgccacct

SEQ ID NO: 838961 - DNA, 20 bp, mouse
gcagacattgttttggttgc

SEQ ID NO: 838962 - DNA, 20 bp, mouse
gtgctggcctggaaaaatct

SEQ ID NO: 838963 - DNA, 20 bp, mouse
gaaaagctcagacattgttt

SEQ ID NO: 838964 - DNA, 20 bp, mouse
ggcattgtgaaaactcctca

SEQ ID NO: 838965 - DNA, 20 bp, mouse
gtctcctatgaacaggggtc

SEQ ID NO: 838966 - DNA, 20 bp, mouse
gggagggcgtgtcacgtgaa

SEQ ID NO: 838967 - DNA, 20 bp, mouse
gaaagcggaacaagttctcg

SEQ ID NO: 838968 - DNA, 20 bp, mouse
gcccgcctccgccggagacg

SEQ ID NO: 838969 - DNA, 20 bp, mouse
gaacaagttctcgtggacag

SEQ ID NO: 838970 - DNA, 20 bp, mouse
gatgggaaaggataacgtgc

SEQ ID NO: 838971 - DNA, 20 bp, mouse
ggctgccgcggccccgtctc

SEQ ID NO: 838972 - DNA, 20 bp, mouse
ggggaatctggtcattaaag

SEQ ID NO: 838973 - DNA, 20 bp, mouse
ggtgaagggcgcgcttactg

SEQ ID NO: 838974 - DNA, 20 bp, mouse
gtccctggtgttgctggctt

SEQ ID NO: 838975 - DNA, 20 bp, mouse
gcagctcggcgtttcccggc

SEQ ID NO: 838976 - DNA, 20 bp, mouse
gcgagcaagggtggaaatca

SEQ ID NO: 838977 - DNA, 20 bp, mouse
gaagcttagtgcaggaggtg

SEQ ID NO: 838978 - DNA, 20 bp, mouse
gttagcatttctgcatactt

SEQ ID NO: 838979 - DNA, 20 bp, mouse
gcaaagaagcttagtgcagg

SEQ ID NO: 838980 - DNA, 20 bp, mouse
gtcagggatgctaaccttac

SEQ ID NO: 838981 - DNA, 20 bp, mouse
gtgcatacttaggcactgca

SEQ ID NO: 838982 - DNA, 20 bp, mouse
gttaatctattggcgagcaa

SEQ ID NO: 838983 - DNA, 20 bp, mouse
ggcccctaactgtagagatt

SEQ ID NO: 838984 - DNA, 20 bp, mouse
gtcactgagctgcctacaca

SEQ ID NO: 838985 - DNA, 20 bp, mouse
gttaaaaaccacaaatgaga

SEQ ID NO: 838986 - DNA, 20 bp, mouse
gcgcggtccccagttgtcgc

SEQ ID NO: 838987 - DNA, 20 bp, mouse
gcaccagcccgcgacaactg

SEQ ID NO: 838988 - DNA, 20 bp, mouse
ggacaactggggaccgcgcg

SEQ ID NO: 838989 - DNA, 20 bp, mouse
gtcccccagcccgtccggtg

SEQ ID NO: 838990 - DNA, 20 bp, mouse
gcggcggcggcgggtgctcg

SEQ ID NO: 838991 - DNA, 20 bp, mouse
ggctgtgttgccctggccga

SEQ ID NO: 838992 - DNA, 20 bp, mouse
gccgcccctcccccaccgga

SEQ ID NO: 838993 - DNA, 20 bp, mouse
gcggacgggctgggggagga

SEQ ID NO: 838994 - DNA, 20 bp, mouse
gtatctgggcagcatcgcct

SEQ ID NO: 838995 - DNA, 20 bp, mouse
ggggtcaagttcagccgccg

SEQ ID NO: 838996 - DNA, 20 bp, mouse
gggtacttccgcttggggaa

SEQ ID NO: 838997 - DNA, 20 bp, mouse
gctagtgctgctgggtggta

SEQ ID NO: 838998 - DNA, 20 bp, mouse
gggaaaggggtggactttgg

SEQ ID NO: 838999 - DNA, 20 bp, mouse
gacacgcttgatctactccc

SEQ ID NO: 839000 - DNA, 20 bp, mouse
gggagcactcaggagttctg

SEQ ID NO: 839001 - DNA, 20 bp, mouse
gtgaacacggactggctaat

SEQ ID NO: 839002 - DNA, 20 bp, mouse
gaggagtcctacctccaacc

SEQ ID NO: 839003 - DNA, 20 bp, mouse
ggatcaagcttccagatcct

SEQ ID NO: 839004 - DNA, 20 bp, mouse
gcagcagcagggacacctcg

SEQ ID NO: 839005 - DNA, 20 bp, mouse
gagatcaagcgtgtccaggt

SEQ ID NO: 839006 - DNA, 20 bp, mouse
gtcggccctggcatgactgg

SEQ ID NO: 839007 - DNA, 20 bp, mouse
gccacggctccgattcccag

SEQ ID NO: 839008 - DNA, 20 bp, mouse
gcctgccgtacaccagggga

SEQ ID NO: 839009 - DNA, 20 bp, mouse
gcatccctgccgtacaccag

SEQ ID NO: 839010 - DNA, 20 bp, mouse
ggctaagtgcacctcggccc

SEQ ID NO: 839011 - DNA, 20 bp, mouse
gcccacccccagtcatgcca

SEQ ID NO: 839012 - DNA, 20 bp, mouse
ggaaaaagggcaaaaatgat

SEQ ID NO: 839013 - DNA, 20 bp, mouse
gatgggctctgggcatactc

SEQ ID NO: 839014 - DNA, 20 bp, mouse
gaagagctaaggcatggctt

SEQ ID NO: 839015 - DNA, 20 bp, mouse
gggcctccagacgagacagg

SEQ ID NO: 839016 - DNA, 20 bp, mouse
gaagcccctggggcagtcag

SEQ ID NO: 839017 - DNA, 20 bp, mouse
gactgccccaggggcttctc

SEQ ID NO: 839018 - DNA, 20 bp, mouse
ggcagtcagaggaagttctg

SEQ ID NO: 839019 - DNA, 20 bp, mouse
gtggaagctggcacaggtgt

SEQ ID NO: 839020 - DNA, 20 bp, mouse
gggtgggcgtcagtgtttta

SEQ ID NO: 839021 - DNA, 20 bp, mouse
gggtggaagtgcaccgatgg

SEQ ID NO: 839022 - DNA, 20 bp, mouse
ggtgggtggaagtgcaccga

SEQ ID NO: 839023 - DNA, 20 bp, mouse
gcttctctggctacagttgt

SEQ ID NO: 839024 - DNA, 20 bp, mouse
gccagcttccacccaagcct

SEQ ID NO: 839025 - DNA, 20 bp, mouse
ggaaccaaatggccggggga

SEQ ID NO: 839026 - DNA, 20 bp, mouse
gctgcaaggagtcacctctt

SEQ ID NO: 839027 - DNA, 20 bp, mouse
gaagacacctgccttgcccc

SEQ ID NO: 839028 - DNA, 20 bp, mouse
gtggctaagtatgttattat

SEQ ID NO: 839029 - DNA, 20 bp, mouse
gcagctagaccctaaactgg

SEQ ID NO: 839030 - DNA, 20 bp, mouse
gctgttgctcaaatgtgctt

SEQ ID NO: 839031 - DNA, 20 bp, mouse
gacatttgagcaacagtgga

SEQ ID NO: 839032 - DNA, 20 bp, mouse
gctggtctagctctactgag

SEQ ID NO: 839033 - DNA, 20 bp, mouse
gagctgggcgaggccccaag

SEQ ID NO: 839034 - DNA, 20 bp, mouse
gctaagtatgttattatagg

SEQ ID NO: 839035 - DNA, 20 bp, mouse
gtcttaggagtacgtttcta

SEQ ID NO: 839036 - DNA, 20 bp, mouse
ggatcaaatgtatgagggaa

SEQ ID NO: 839037 - DNA, 20 bp, mouse
gacagggaacttactgatca

SEQ ID NO: 839038 - DNA, 20 bp, mouse
ggggaaatgggacccattac

SEQ ID NO: 839039 - DNA, 20 bp, mouse
gcagaacagcctcaccccat

SEQ ID NO: 839040 - DNA, 20 bp, mouse
ggcaggaaaggtgcttgttg

SEQ ID NO: 839041 - DNA, 20 bp, mouse
gtgactcacgcaggacacgt

SEQ ID NO: 839042 - DNA, 20 bp, mouse
ggtgtggaggtgactcacgc

SEQ ID NO: 839043 - DNA, 20 bp, mouse
gagtctcctcacttgggaaa

SEQ ID NO: 839044 - DNA, 20 bp, mouse
gtggctgggccacctgccct

SEQ ID NO: 839045 - DNA, 20 bp, mouse
gctgtcatggagagacaaga

SEQ ID NO: 839046 - DNA, 20 bp, mouse
gggcctgggcgcaggaacca

SEQ ID NO: 839047 - DNA, 20 bp, mouse
ggccgggcaagcgggttccc

SEQ ID NO: 839048 - DNA, 20 bp, mouse
gtcccgggctgggcaggcga

SEQ ID NO: 839049 - DNA, 20 bp, mouse
gcgcaggaaccagggatgaa

SEQ ID NO: 839050 - DNA, 20 bp, mouse
ggctgggcaggcgacggcct

SEQ ID NO: 839051 - DNA, 20 bp, mouse
gcgcaggccggggaggaccc

SEQ ID NO: 839052 - DNA, 20 bp, mouse
gcgcgaggcacaccgggcac

SEQ ID NO: 839053 - DNA, 20 bp, mouse
gggcacaccgggcactggag

SEQ ID NO: 839054 - DNA, 20 bp, mouse
gaaaaggaacggtgatgtta

SEQ ID NO: 839055 - DNA, 20 bp, mouse
gtgcgcgccgccacctggct

SEQ ID NO: 839056 - DNA, 20 bp, mouse
gaaacagcctggtgtaggga

SEQ ID NO: 839057 - DNA, 20 bp, mouse
gaggtggggccaaggaattt

SEQ ID NO: 839058 - DNA, 20 bp, mouse
gtcgacgcggcaggaggaat

SEQ ID NO: 839059 - DNA, 20 bp, mouse
gcataaaacagcctggtgta

SEQ ID NO: 839060 - DNA, 20 bp, mouse
gcagcccactgccaagaatc

SEQ ID NO: 839061 - DNA, 20 bp, mouse
gaggggaagaacctgattct

SEQ ID NO: 839062 - DNA, 20 bp, mouse
gaaggtgaaacaggtaccct

SEQ ID NO: 839063 - DNA, 20 bp, mouse
gcggcaggaggaatgggttc

SEQ ID NO: 839064 - DNA, 20 bp, mouse
gcaaggctagagaattctga

SEQ ID NO: 839065 - DNA, 20 bp, mouse
ggctccctccccaaattcct

SEQ ID NO: 839066 - DNA, 20 bp, mouse
gaggaaggctgggacaggtc

SEQ ID NO: 839067 - DNA, 20 bp, mouse
gtgggtatcccaaagtccag

SEQ ID NO: 839068 - DNA, 20 bp, mouse
gagaacaggggaagagttcc

SEQ ID NO: 839069 - DNA, 20 bp, mouse
gcaggctcattgcaggatgg

SEQ ID NO: 839070 - DNA, 20 bp, mouse
gcagtgacctttttctagga

SEQ ID NO: 839071 - DNA, 20 bp, mouse
gtttctaggaaggctgggac

SEQ ID NO: 839072 - DNA, 20 bp, mouse
gggtcaggctcattgcagga

SEQ ID NO: 839073 - DNA, 20 bp, mouse
ggagtgagcaggagctatgt

SEQ ID NO: 839074 - DNA, 20 bp, mouse
ggagctggcccctggacttt

SEQ ID NO: 839075 - DNA, 20 bp, mouse
gctcagtaggcaggactttg

SEQ ID NO: 839076 - DNA, 20 bp, mouse
gaggaaaagggacacggggt

SEQ ID NO: 839077 - DNA, 20 bp, mouse
ggcggtctgccgccttgggt

SEQ ID NO: 839078 - DNA, 20 bp, mouse
gacctaggccggtggggctc

SEQ ID NO: 839079 - DNA, 20 bp, mouse
gtgcgaggaaaagggacacg

SEQ ID NO: 839080 - DNA, 20 bp, mouse
gcccagagccccaccggcct

SEQ ID NO: 839081 - DNA, 20 bp, mouse
gcagcagcccagagccccac

SEQ ID NO: 839082 - DNA, 20 bp, mouse
gctcgcaggaaccagactga

SEQ ID NO: 839083 - DNA, 20 bp, mouse
gaggggcggtctgccgcctt

SEQ ID NO: 839084 - DNA, 20 bp, mouse
gcgcccaggccgcacccact

SEQ ID NO: 839085 - DNA, 20 bp, mouse
gccaggccgcacccacttgg

SEQ ID NO: 839086 - DNA, 20 bp, mouse
gacacatgcaggttatgggg

SEQ ID NO: 839087 - DNA, 20 bp, mouse
gaatgctcttagtcgtgaag

SEQ ID NO: 839088 - DNA, 20 bp, mouse
gtagtcgtgaagaggtacat

SEQ ID NO: 839089 - DNA, 20 bp, mouse
gtagtccataggctcggtat

SEQ ID NO: 839090 - DNA, 20 bp, mouse
gtctgggaattgtagtccat

SEQ ID NO: 839091 - DNA, 20 bp, mouse
gacaaattaggtgtttgcgt

SEQ ID NO: 839092 - DNA, 20 bp, mouse
gtggcatctcggagttctgc

SEQ ID NO: 839093 - DNA, 20 bp, mouse
gacacacacatgcaggttat

SEQ ID NO: 839094 - DNA, 20 bp, mouse
ggtaacctacagtttagcag

SEQ ID NO: 839095 - DNA, 20 bp, mouse
gtaggctcggtataggccaa

SEQ ID NO: 839096 - DNA, 20 bp, mouse
gaattcggttgctcgatatc

SEQ ID NO: 839097 - DNA, 20 bp, mouse
gaagagatggagaagaaaat

SEQ ID NO: 839098 - DNA, 20 bp, mouse
gccgggggggaaataagaga

SEQ ID NO: 839099 - DNA, 20 bp, mouse
gaaggcggctacctacagta

SEQ ID NO: 839100 - DNA, 20 bp, mouse
gtcctgccaaggaaacaagg

SEQ ID NO: 839101 - DNA, 20 bp, mouse
ggtgacgagtaattcacatc

SEQ ID NO: 839102 - DNA, 20 bp, mouse
gtacagtagggaccacattt

SEQ ID NO: 839103 - DNA, 20 bp, mouse
gactccagatcttggaaaag

SEQ ID NO: 839104 - DNA, 20 bp, mouse
gtatcgagcaaccgaattct

SEQ ID NO: 839105 - DNA, 20 bp, mouse
gtcttcctgccaaggaaaca

SEQ ID NO: 839106 - DNA, 20 bp, mouse
gaatgtgagtctctggaaag

SEQ ID NO: 839107 - DNA, 20 bp, mouse
gcagtgataatgtgagtctc

SEQ ID NO: 839108 - DNA, 20 bp, mouse
ggggctccgtctgctactac

SEQ ID NO: 839109 - DNA, 20 bp, mouse
gaatggccttcttaccaaga

SEQ ID NO: 839110 - DNA, 20 bp, mouse
gctggaaaggggaaagctac

SEQ ID NO: 839111 - DNA, 20 bp, mouse
gagattagggagttttccaa

SEQ ID NO: 839112 - DNA, 20 bp, mouse
gggtcctgagccttggatat

SEQ ID NO: 839113 - DNA, 20 bp, mouse
gggccttcttaccaagaagg

SEQ ID NO: 839114 - DNA, 20 bp, mouse
gtttcttcttggctcagaga

SEQ ID NO: 839115 - DNA, 20 bp, mouse
gggaaaactccctaatctct

SEQ ID NO: 839116 - DNA, 20 bp, mouse
ggggtgaggtacaagtgata

SEQ ID NO: 839117 - DNA, 20 bp, mouse
gtgataaggaaatttactcc

SEQ ID NO: 839118 - DNA, 20 bp, mouse
gggtactgtggcagatatgc

SEQ ID NO: 839119 - DNA, 20 bp, mouse
ggaaaatggtattggtactg

SEQ ID NO: 839120 - DNA, 20 bp, mouse
gacagaacagagataatcca

SEQ ID NO: 839121 - DNA, 20 bp, mouse
gtagaggttttgtgaaacac

SEQ ID NO: 839122 - DNA, 20 bp, mouse
ggtttgtctaccctgtgtgt

SEQ ID NO: 839123 - DNA, 20 bp, mouse
gtttactccgggtgcagaca

SEQ ID NO: 839124 - DNA, 20 bp, mouse
gcttcagatcagccttagaa

SEQ ID NO: 839125 - DNA, 20 bp, mouse
gattcatcatagcctttcta

SEQ ID NO: 839126 - DNA, 20 bp, mouse
gtatgtgaggtacatgtgat

SEQ ID NO: 839127 - DNA, 20 bp, mouse
gctgagaaggagttactaat

SEQ ID NO: 839128 - DNA, 20 bp, mouse
gtctgctctgtgactatgtg

SEQ ID NO: 839129 - DNA, 20 bp, mouse
ggaaggagttactaatggga

SEQ ID NO: 839130 - DNA, 20 bp, mouse
gaaacatttcatcatattgt

SEQ ID NO: 839131 - DNA, 20 bp, mouse
gatattgtaggcatgaatag

SEQ ID NO: 839132 - DNA, 20 bp, mouse
gacctctttacatgaaccta

SEQ ID NO: 839133 - DNA, 20 bp, mouse
gacctggtattggtatgtat

SEQ ID NO: 839134 - DNA, 20 bp, mouse
gttcatgtaaagaggttatg

SEQ ID NO: 839135 - DNA, 20 bp, mouse
gtacattagggtataaagac

SEQ ID NO: 839136 - DNA, 20 bp, mouse
gatagagagggcatgatgta

SEQ ID NO: 839137 - DNA, 20 bp, mouse
gagggcatgatgtaggggac

SEQ ID NO: 839138 - DNA, 20 bp, mouse
gcctctacgcaagaaaggca

SEQ ID NO: 839139 - DNA, 20 bp, mouse
ggggaatcggcagaaccttc

SEQ ID NO: 839140 - DNA, 20 bp, mouse
ggtgattggcggcacttcag

SEQ ID NO: 839141 - DNA, 20 bp, mouse
gtgctcagtgagttcaggga

SEQ ID NO: 839142 - DNA, 20 bp, mouse
gcggggctaatactgtcgat

SEQ ID NO: 839143 - DNA, 20 bp, mouse
ggacgcaagcgcttgcgcac

SEQ ID NO: 839144 - DNA, 20 bp, mouse
ggagcacgagcactggacgg

SEQ ID NO: 839145 - DNA, 20 bp, mouse
gcacgagggccgagtcatgg

SEQ ID NO: 839146 - DNA, 20 bp, mouse
gtggaggcggggacggcgga

SEQ ID NO: 839147 - DNA, 20 bp, mouse
ggacggcggaaggatcgtga

SEQ ID NO: 839148 - DNA, 20 bp, mouse
ggcggaaggatcgtgaaggt

SEQ ID NO: 839149 - DNA, 20 bp, mouse
gactctggccatctggcatt

SEQ ID NO: 839150 - DNA, 20 bp, mouse
gcacttatgacgatacaagc

SEQ ID NO: 839151 - DNA, 20 bp, mouse
gagtcacaagatctctcagt

SEQ ID NO: 839152 - DNA, 20 bp, mouse
gaatgtggaggcggggacgg

SEQ ID NO: 839153 - DNA, 20 bp, mouse
ggaagcgtctcgagcggcgg

SEQ ID NO: 839154 - DNA, 20 bp, mouse
gtggcgtgaagcgtctcgag

SEQ ID NO: 839155 - DNA, 20 bp, mouse
ggggaggggcggccacgtga

SEQ ID NO: 839156 - DNA, 20 bp, mouse
gagcccaggcatgaactcag

SEQ ID NO: 839157 - DNA, 20 bp, mouse
ggcgtcggaagggtgtaggg

SEQ ID NO: 839158 - DNA, 20 bp, mouse
ggactaggatcgcgtcggaa

SEQ ID NO: 839159 - DNA, 20 bp, mouse
gtgcgcgttgagcaagtggt

SEQ ID NO: 839160 - DNA, 20 bp, mouse
gcgcgcgactaggatcgcgt

SEQ ID NO: 839161 - DNA, 20 bp, mouse
gacctgcagcagcctctcgc

SEQ ID NO: 839162 - DNA, 20 bp, mouse
gatgaactcaggggtgcgga

SEQ ID NO: 839163 - DNA, 20 bp, mouse
ggagcaagtggtgggatcgc

SEQ ID NO: 839164 - DNA, 20 bp, mouse
ggcacccctgagttcatgcc

SEQ ID NO: 839165 - DNA, 20 bp, mouse
ggcggatggtgactcgcagt

SEQ ID NO: 839166 - DNA, 20 bp, mouse
gttgggcgccacctcctcca

SEQ ID NO: 839167 - DNA, 20 bp, mouse
ggcccgcacgcttacgtcta

SEQ ID NO: 839168 - DNA, 20 bp, mouse
gtgcgggcaccgggagcttt

SEQ ID NO: 839169 - DNA, 20 bp, mouse
gccaaggctcgctcgcgtca

SEQ ID NO: 839170 - DNA, 20 bp, mouse
ggcgcctccccgcctatatg

SEQ ID NO: 839171 - DNA, 20 bp, mouse
gtccaaagcagtccctgcgg

SEQ ID NO: 839172 - DNA, 20 bp, mouse
ggccgccgcagggactgctt

SEQ ID NO: 839173 - DNA, 20 bp, mouse
ggacgtaagcgtgcgggcac

SEQ ID NO: 839174 - DNA, 20 bp, mouse
gaggcccgccccgcgctccc

SEQ ID NO: 839175 - DNA, 20 bp, mouse
gtcccttagacgtaagcgtg

SEQ ID NO: 839176 - DNA, 20 bp, mouse
ggcgacgcggaggaagaagg

SEQ ID NO: 839177 - DNA, 20 bp, mouse
ggcggcgacgcggaggaaga

SEQ ID NO: 839178 - DNA, 20 bp, mouse
gggaggcagccctccgtccc

SEQ ID NO: 839179 - DNA, 20 bp, mouse
ggggctagagcccgggacgg

SEQ ID NO: 839180 - DNA, 20 bp, mouse
gtggcccccggactgcgctc

SEQ ID NO: 839181 - DNA, 20 bp, mouse
gacctccagccccgtccgtc

SEQ ID NO: 839182 - DNA, 20 bp, mouse
ggcggcggaagcccgctcgg

SEQ ID NO: 839183 - DNA, 20 bp, mouse
gccggcgcttcctgacggac

SEQ ID NO: 839184 - DNA, 20 bp, mouse
gccggccaggagagcccgag

SEQ ID NO: 839185 - DNA, 20 bp, mouse
gcggggctggaggtccgcgg

SEQ ID NO: 839186 - DNA, 20 bp, mouse
gcctccctgaaccttagtca

SEQ ID NO: 839187 - DNA, 20 bp, mouse
gaggctggcaaaacccaaac

SEQ ID NO: 839188 - DNA, 20 bp, mouse
ggtaggggacgcaggaaggg

SEQ ID NO: 839189 - DNA, 20 bp, mouse
gagtccctgactaaggttca

SEQ ID NO: 839190 - DNA, 20 bp, mouse
gtgaagagaagtgactccaa

SEQ ID NO: 839191 - DNA, 20 bp, mouse
gggaggggatgtggtttaac

SEQ ID NO: 839192 - DNA, 20 bp, mouse
ggggaacagggaccagcgca

SEQ ID NO: 839193 - DNA, 20 bp, mouse
gggtagaaagcattcagcag

SEQ ID NO: 839194 - DNA, 20 bp, mouse
gggggtaggggacgcaggaa

SEQ ID NO: 839195 - DNA, 20 bp, mouse
gcagcctccaaagtcctctt

SEQ ID NO: 839196 - DNA, 20 bp, mouse
gcaactgtaggctgcggctg

SEQ ID NO: 839197 - DNA, 20 bp, mouse
gcatgagggcggagaaaaag

SEQ ID NO: 839198 - DNA, 20 bp, mouse
gcagctacagcagcaactgt

SEQ ID NO: 839199 - DNA, 20 bp, mouse
gtcctccctcctccctccta

SEQ ID NO: 839200 - DNA, 20 bp, mouse
ggcagggagccttaggaggg

SEQ ID NO: 839201 - DNA, 20 bp, mouse
ggccgctgcgggtcccaaac

SEQ ID NO: 839202 - DNA, 20 bp, mouse
gctggaacctggcaggtgta

SEQ ID NO: 839203 - DNA, 20 bp, mouse
gcaactcttcctcggaggga

SEQ ID NO: 839204 - DNA, 20 bp, mouse
gggaatccctggcctcccgc

SEQ ID NO: 839205 - DNA, 20 bp, mouse
gtgccagctggcccggagcc

SEQ ID NO: 839206 - DNA, 20 bp, mouse
ggggcaagatggctggcatg

SEQ ID NO: 839207 - DNA, 20 bp, mouse
gtcagctggtaagagggtgt

SEQ ID NO: 839208 - DNA, 20 bp, mouse
gccaatctgggagtggtgcc

SEQ ID NO: 839209 - DNA, 20 bp, mouse
gcccgcccactgtggagcca

SEQ ID NO: 839210 - DNA, 20 bp, mouse
gcactgtggagccaagggag

SEQ ID NO: 839211 - DNA, 20 bp, mouse
gactcccagattggagggga

SEQ ID NO: 839212 - DNA, 20 bp, mouse
ggagtggtgccagggtgaga

SEQ ID NO: 839213 - DNA, 20 bp, mouse
gcaccactcccagattggag

SEQ ID NO: 839214 - DNA, 20 bp, mouse
ggtcagggacaggtgcccta

SEQ ID NO: 839215 - DNA, 20 bp, mouse
ggaggggctatggggcaaga

SEQ ID NO: 839216 - DNA, 20 bp, mouse
gccagtctgggcaggttgta

SEQ ID NO: 839217 - DNA, 20 bp, mouse
gaacctgcccagactggagg

SEQ ID NO: 839218 - DNA, 20 bp, mouse
gcagactggaggtggtgaag

SEQ ID NO: 839219 - DNA, 20 bp, mouse
ggggccacgccctctgacta

SEQ ID NO: 839220 - DNA, 20 bp, mouse
ggagagcacgggtttatgaa

SEQ ID NO: 839221 - DNA, 20 bp, mouse
gtcccgccgcgcacactggg

SEQ ID NO: 839222 - DNA, 20 bp, mouse
ggggcggagctcatccgcgc

SEQ ID NO: 839223 - DNA, 20 bp, mouse
gacgccctctgactagggac

SEQ ID NO: 839224 - DNA, 20 bp, mouse
gcgacagcagggcattgaat

SEQ ID NO: 839225 - DNA, 20 bp, mouse
gctccgcccagtgtgcgcgg

SEQ ID NO: 839226 - DNA, 20 bp, mouse
ggggcggaatgtatcgtcag

SEQ ID NO: 839227 - DNA, 20 bp, mouse
gcccccggctaagtctaatg

SEQ ID NO: 839228 - DNA, 20 bp, mouse
gcggctaagtctaatgagga

SEQ ID NO: 839229 - DNA, 20 bp, mouse
gtagacttagccgggggatg

SEQ ID NO: 839230 - DNA, 20 bp, mouse
gtctaatgaggaaggctaag

SEQ ID NO: 839231 - DNA, 20 bp, mouse
gggggttgctgtgagaatta

SEQ ID NO: 839232 - DNA, 20 bp, mouse
ggttgctgtgagaattaagg

SEQ ID NO: 839233 - DNA, 20 bp, mouse
gaggtcaagggcagcctttt

SEQ ID NO: 839234 - DNA, 20 bp, mouse
gtgactctgaggctgttcga

SEQ ID NO: 839235 - DNA, 20 bp, mouse
gctgcagccgtcaagcagtg

SEQ ID NO: 839236 - DNA, 20 bp, mouse
gccactccggtctgcacaaa

SEQ ID NO: 839237 - DNA, 20 bp, mouse
gacggaggacgcgctacgta

SEQ ID NO: 839238 - DNA, 20 bp, mouse
ggcggggccgacatgactgg

SEQ ID NO: 839239 - DNA, 20 bp, mouse
gtgggcacttcgaaagggga

SEQ ID NO: 839240 - DNA, 20 bp, mouse
gcgtcctccgtcatcccgtc

SEQ ID NO: 839241 - DNA, 20 bp, mouse
gggggcggggccgacatgac

SEQ ID NO: 839242 - DNA, 20 bp, mouse
gaccttgagggtcattgctc

SEQ ID NO: 839243 - DNA, 20 bp, mouse
ggacatgactggtggatttg

SEQ ID NO: 839244 - DNA, 20 bp, mouse
gtctctgaggggacgagaga

SEQ ID NO: 839245 - DNA, 20 bp, mouse
gaagaccggaaaacggcgaa

SEQ ID NO: 839246 - DNA, 20 bp, mouse
gaggaaggcgcgaggctcga

SEQ ID NO: 839247 - DNA, 20 bp, mouse
ggaagcgctggaaacggaat

SEQ ID NO: 839248 - DNA, 20 bp, mouse
ggggacccagctcgatgtgc

SEQ ID NO: 839249 - DNA, 20 bp, mouse
ggaaacctgcacatcgagct

SEQ ID NO: 839250 - DNA, 20 bp, mouse
gcgcgcgcagccgcagacag

SEQ ID NO: 839251 - DNA, 20 bp, mouse
gccggcccgggggatggcgt

SEQ ID NO: 839252 - DNA, 20 bp, mouse
gaggaccgcgcggaatgccg

SEQ ID NO: 839253 - DNA, 20 bp, mouse
gggagcccgaacccgaaccc

SEQ ID NO: 839254 - DNA, 20 bp, mouse
gaccgcgcggaatgccgggg

SEQ ID NO: 839255 - DNA, 20 bp, mouse
gacacacggggcaggtagga

SEQ ID NO: 839256 - DNA, 20 bp, mouse
gcacacacggcaggtaagta

SEQ ID NO: 839257 - DNA, 20 bp, mouse
ggggctcaggaaattgccca

SEQ ID NO: 839258 - DNA, 20 bp, mouse
gcagacgggacgccggccta

SEQ ID NO: 839259 - DNA, 20 bp, mouse
gtcctcgcgccacgcgttct

SEQ ID NO: 839260 - DNA, 20 bp, mouse
gcacggcaggtaagtagggt

SEQ ID NO: 839261 - DNA, 20 bp, mouse
gcgtcccgtctgtgcgccga

SEQ ID NO: 839262 - DNA, 20 bp, mouse
gtcccagaacgcgtggcgcg

SEQ ID NO: 839263 - DNA, 20 bp, mouse
gggctctcgcgccacgccgt

SEQ ID NO: 839264 - DNA, 20 bp, mouse
ggggacgccggcctacggcg

SEQ ID NO: 839265 - DNA, 20 bp, mouse
gggtctgaggaaataagaat

SEQ ID NO: 839266 - DNA, 20 bp, mouse
ggggacttcgggaccgcgaa

SEQ ID NO: 839267 - DNA, 20 bp, mouse
gcgagccttgccacccgctg

SEQ ID NO: 839268 - DNA, 20 bp, mouse
gggtggcaaggctcgcgaga

SEQ ID NO: 839269 - DNA, 20 bp, mouse
gtcgggcgagagatcaggtc

SEQ ID NO: 839270 - DNA, 20 bp, mouse
gttccggggccgctggtctg

SEQ ID NO: 839271 - DNA, 20 bp, mouse
gcgaagtcgggcgagagatc

SEQ ID NO: 839272 - DNA, 20 bp, mouse
gccacccgctgcggctcgga

SEQ ID NO: 839273 - DNA, 20 bp, mouse
gaagcggaagcacaacgtgc

SEQ ID NO: 839274 - DNA, 20 bp, mouse
ggcaaggctcgcgagagggc

SEQ ID NO: 839275 - DNA, 20 bp, mouse
gcaccgcagaccagcggccc

SEQ ID NO: 839276 - DNA, 20 bp, mouse
ggcaccgatgggcccggaaa

SEQ ID NO: 839277 - DNA, 20 bp, mouse
gagggcgcgccggacggaag

SEQ ID NO: 839278 - DNA, 20 bp, mouse
gcgcctctcagggctccgac

SEQ ID NO: 839279 - DNA, 20 bp, mouse
ggcgcctgcgcggcaccgat

SEQ ID NO: 839280 - DNA, 20 bp, mouse
gcggccacgcagcgccgaga

SEQ ID NO: 839281 - DNA, 20 bp, mouse
gccggacggaagtggagcgt

SEQ ID NO: 839282 - DNA, 20 bp, mouse
ggggctagaggatggttact

SEQ ID NO: 839283 - DNA, 20 bp, mouse
ggcgcgaaggctattgccca

SEQ ID NO: 839284 - DNA, 20 bp, mouse
ggggcccatcggtgccgcgc

SEQ ID NO: 839285 - DNA, 20 bp, mouse
gcgagagggcgtgtcgagac

SEQ ID NO: 839286 - DNA, 20 bp, mouse
gtccctgctgcagagtaagt

SEQ ID NO: 839287 - DNA, 20 bp, mouse
ggcggctgctccataaagcc

SEQ ID NO: 839288 - DNA, 20 bp, mouse
gcatttgtttcccaggactt

SEQ ID NO: 839289 - DNA, 20 bp, mouse
gccccacagtccctcacctc

SEQ ID NO: 839290 - DNA, 20 bp, mouse
ggcatgtaatccagaggtga

SEQ ID NO: 839291 - DNA, 20 bp, mouse
ggtaagtagggagaggtctc

SEQ ID NO: 839292 - DNA, 20 bp, mouse
ggaagaccacggtagcatag

SEQ ID NO: 839293 - DNA, 20 bp, mouse
ggcaggttcctggtgataaa

SEQ ID NO: 839294 - DNA, 20 bp, mouse
gaaaaggaggatgtccgtcc

SEQ ID NO: 839295 - DNA, 20 bp, mouse
gaggatgtccgtccgggatc

SEQ ID NO: 839296 - DNA, 20 bp, mouse
gatgctggccagtcagcggg

SEQ ID NO: 839297 - DNA, 20 bp, mouse
gagagatgagatgagaatgt

SEQ ID NO: 839298 - DNA, 20 bp, mouse
ggagatgagaatgttggtta

SEQ ID NO: 839299 - DNA, 20 bp, mouse
gaggataggtcagatagata

SEQ ID NO: 839300 - DNA, 20 bp, mouse
gagagatgctggccagtcag

SEQ ID NO: 839301 - DNA, 20 bp, mouse
gtaagtgtgttatacacaca

SEQ ID NO: 839302 - DNA, 20 bp, mouse
gggaagcaatgaagagatgc

SEQ ID NO: 839303 - DNA, 20 bp, mouse
gaatgcccaaagacattgac

SEQ ID NO: 839304 - DNA, 20 bp, mouse
ggaagaatccaatggttagg

SEQ ID NO: 839305 - DNA, 20 bp, mouse
gtcagctagctccttaaaaa

SEQ ID NO: 839306 - DNA, 20 bp, mouse
ggacatggacaagttgtctt

SEQ ID NO: 839307 - DNA, 20 bp, mouse
ggcacgagcgtgcctggtga

SEQ ID NO: 839308 - DNA, 20 bp, mouse
ggtaccatttctgacactca

SEQ ID NO: 839309 - DNA, 20 bp, mouse
gcccccatgagtgtcagaaa

SEQ ID NO: 839310 - DNA, 20 bp, mouse
gagagtctagttttagtagg

SEQ ID NO: 839311 - DNA, 20 bp, mouse
gtgtcttggggttgttgaag

SEQ ID NO: 839312 - DNA, 20 bp, mouse
ggtgacgaaccagactttat

SEQ ID NO: 839313 - DNA, 20 bp, mouse
ggcagaataaaatgccccgt

SEQ ID NO: 839314 - DNA, 20 bp, mouse
gcaggtcctcagccaatagt

SEQ ID NO: 839315 - DNA, 20 bp, mouse
gtaactaaagtgaatgtatg

SEQ ID NO: 839316 - DNA, 20 bp, mouse
gagaggggaattatcctgaa

SEQ ID NO: 839317 - DNA, 20 bp, mouse
gtacgaatctctacatgagc

SEQ ID NO: 839318 - DNA, 20 bp, mouse
gaataatgtcagagtttcca

SEQ ID NO: 839319 - DNA, 20 bp, mouse
gcaggcagactggaacactc

SEQ ID NO: 839320 - DNA, 20 bp, mouse
gtctacatgagcaggcagac

SEQ ID NO: 839321 - DNA, 20 bp, mouse
gtgtctaaacaagttttatt

SEQ ID NO: 839322 - DNA, 20 bp, mouse
gaaaggataggccattaaat

SEQ ID NO: 839323 - DNA, 20 bp, mouse
gtataaacaagaagatcaga

SEQ ID NO: 839324 - DNA, 20 bp, mouse
gtgagatgtcaaatttattt

SEQ ID NO: 839325 - DNA, 20 bp, mouse
gttgtcatacatggttcagt

SEQ ID NO: 839326 - DNA, 20 bp, mouse
gggaccgaggttgggtgtct

SEQ ID NO: 839327 - DNA, 20 bp, mouse
ggacagggagggaacgacac

SEQ ID NO: 839328 - DNA, 20 bp, mouse
gggagagcacgctggagagg

SEQ ID NO: 839329 - DNA, 20 bp, mouse
gcggaacagaaggcgctgcg

SEQ ID NO: 839330 - DNA, 20 bp, mouse
ggggaggaggagggctccga

SEQ ID NO: 839331 - DNA, 20 bp, mouse
ggggaacgacacagggaccg

SEQ ID NO: 839332 - DNA, 20 bp, mouse
gaccggggacccacccaaat

SEQ ID NO: 839333 - DNA, 20 bp, mouse
gacgacacagggaccgaggt

SEQ ID NO: 839334 - DNA, 20 bp, mouse
gagagacccgggtgcaggag

SEQ ID NO: 839335 - DNA, 20 bp, mouse
ggaactaataggtgacaggg

SEQ ID NO: 839336 - DNA, 20 bp, mouse
ggggctgtgttgtaatgcac

SEQ ID NO: 839337 - DNA, 20 bp, mouse
gttgcaggaagacgttcagg

SEQ ID NO: 839338 - DNA, 20 bp, mouse
gtgtatgcatgtacacgcgg

SEQ ID NO: 839339 - DNA, 20 bp, mouse
gtgacgttggcgagaggagg

SEQ ID NO: 839340 - DNA, 20 bp, mouse
gtcagggtgacgttggcgag

SEQ ID NO: 839341 - DNA, 20 bp, mouse
gtgcactggctgatctcggg

SEQ ID NO: 839342 - DNA, 20 bp, mouse
gcaccctgacaattacaaat

SEQ ID NO: 839343 - DNA, 20 bp, mouse
gataaaagattgcacgttgc

SEQ ID NO: 839344 - DNA, 20 bp, mouse
ggtaattgtcagggtgacgt

SEQ ID NO: 839345 - DNA, 20 bp, mouse
ggagtggttcagatccacgt

SEQ ID NO: 839346 - DNA, 20 bp, mouse
gacagtgtcccgcctgggag

SEQ ID NO: 839347 - DNA, 20 bp, mouse
gtggagaaagaggacccagc

SEQ ID NO: 839348 - DNA, 20 bp, mouse
ggcagagggagtctattaaa

SEQ ID NO: 839349 - DNA, 20 bp, mouse
gacactccactgccccagtg

SEQ ID NO: 839350 - DNA, 20 bp, mouse
gccgcagagcgccaggcaga

SEQ ID NO: 839351 - DNA, 20 bp, mouse
gcccctccaagaggaagaaa

SEQ ID NO: 839352 - DNA, 20 bp, mouse
gaaagggacagtgtcccgcc

SEQ ID NO: 839353 - DNA, 20 bp, mouse
gggcttggctgcagccctgg

SEQ ID NO: 839354 - DNA, 20 bp, mouse
ggggctgcagccaagccggc

SEQ ID NO: 839355 - DNA, 20 bp, mouse
gggaggggcatctagacagg

SEQ ID NO: 839356 - DNA, 20 bp, mouse
gaccccgcgcacctcgtctg

SEQ ID NO: 839357 - DNA, 20 bp, mouse
gcggggaaggaggagcgcga

SEQ ID NO: 839358 - DNA, 20 bp, mouse
gtccagaggcccgaggagga

SEQ ID NO: 839359 - DNA, 20 bp, mouse
gacgaggtgcgcggggttcg

SEQ ID NO: 839360 - DNA, 20 bp, mouse
gaccgcgctgccggcggaat

SEQ ID NO: 839361 - DNA, 20 bp, mouse
gaagcggggcaggaccgacc

SEQ ID NO: 839362 - DNA, 20 bp, mouse
gaccgaccggggtcgctcct

SEQ ID NO: 839363 - DNA, 20 bp, mouse
ggcacgttcggggatcgcgg

SEQ ID NO: 839364 - DNA, 20 bp, mouse
gcctgcgggcggccgctctc

SEQ ID NO: 839365 - DNA, 20 bp, mouse
gtgcgcggggttcggggctg

SEQ ID NO: 839366 - DNA, 20 bp, mouse
ggggtcacagagaggggtaa

SEQ ID NO: 839367 - DNA, 20 bp, mouse
gtgggactggatcccaaagc

SEQ ID NO: 839368 - DNA, 20 bp, mouse
gtccaccgtgtgctctagac

SEQ ID NO: 839369 - DNA, 20 bp, mouse
ggaagcaagatagatgatct

SEQ ID NO: 839370 - DNA, 20 bp, mouse
gctagagcacacggtggact

SEQ ID NO: 839371 - DNA, 20 bp, mouse
gaagatagatgatctgggac

SEQ ID NO: 839372 - DNA, 20 bp, mouse
gaccactgggtcacagagag

SEQ ID NO: 839373 - DNA, 20 bp, mouse
ggtacaatcaaagccagggc

SEQ ID NO: 839374 - DNA, 20 bp, mouse
gtaagggggagaataggtgc

SEQ ID NO: 839375 - DNA, 20 bp, mouse
ggatcccaaagctggctgca

SEQ ID NO: 839376 - DNA, 20 bp, mouse
ggggacgcgcaactgaagga

SEQ ID NO: 839377 - DNA, 20 bp, mouse
gcggcggcgggcggggacgt

SEQ ID NO: 839378 - DNA, 20 bp, mouse
gtcgttaaagtgcaagtcta

SEQ ID NO: 839379 - DNA, 20 bp, mouse
ggagcacgggttccacccta

SEQ ID NO: 839380 - DNA, 20 bp, mouse
gggagcgtctaaaaagtgcg

SEQ ID NO: 839381 - DNA, 20 bp, mouse
ggcaacaggccaggaagctc

SEQ ID NO: 839382 - DNA, 20 bp, mouse
gggtggaacccgtgctcggc

SEQ ID NO: 839383 - DNA, 20 bp, mouse
gggaacccgtgctcggccgg

SEQ ID NO: 839384 - DNA, 20 bp, mouse
ggccactgggtgccgagcaa

SEQ ID NO: 839385 - DNA, 20 bp, mouse
ggaggccttgtggagtagga

SEQ ID NO: 839386 - DNA, 20 bp, mouse
gccgagagcgcctactggaa

SEQ ID NO: 839387 - DNA, 20 bp, mouse
gcacagccacctcaaaggat

SEQ ID NO: 839388 - DNA, 20 bp, mouse
ggggtggcccgcatccggaa

SEQ ID NO: 839389 - DNA, 20 bp, mouse
ggggtggaagcccttccagt

SEQ ID NO: 839390 - DNA, 20 bp, mouse
gtagctccgcccatcctttg

SEQ ID NO: 839391 - DNA, 20 bp, mouse
gctccgcccatcctttgagg

SEQ ID NO: 839392 - DNA, 20 bp, mouse
gagacccgtgggaaacccag

SEQ ID NO: 839393 - DNA, 20 bp, mouse
ggccaggcacctccctcctg

SEQ ID NO: 839394 - DNA, 20 bp, mouse
gagcagatgccctgggaccc

SEQ ID NO: 839395 - DNA, 20 bp, mouse
gagggcatctgctgtcagca

SEQ ID NO: 839396 - DNA, 20 bp, mouse
ggccactgaagcccctacgt

SEQ ID NO: 839397 - DNA, 20 bp, mouse
gctcttgcccagaatcccga

SEQ ID NO: 839398 - DNA, 20 bp, mouse
ggggacacttggctcgtaga

SEQ ID NO: 839399 - DNA, 20 bp, mouse
ggaggctcggccctgccgtc

SEQ ID NO: 839400 - DNA, 20 bp, mouse
gtcgcctgccgcccgcacgt

SEQ ID NO: 839401 - DNA, 20 bp, mouse
gcggaaacagccctacgtag

SEQ ID NO: 839402 - DNA, 20 bp, mouse
ggtggcccgtggccgtaggc

SEQ ID NO: 839403 - DNA, 20 bp, mouse
gggccctgccgtcgggattc

SEQ ID NO: 839404 - DNA, 20 bp, mouse
ggcccgcacgtaggcatctc

SEQ ID NO: 839405 - DNA, 20 bp, mouse
gctgggcaagagcgcggcac

SEQ ID NO: 839406 - DNA, 20 bp, mouse
gaggctgctcagagaggcga

SEQ ID NO: 839407 - DNA, 20 bp, mouse
gcggacgcagctcccggctg

SEQ ID NO: 839408 - DNA, 20 bp, mouse
gcgggtaggcacttggacgt

SEQ ID NO: 839409 - DNA, 20 bp, mouse
gcggaagtatgtgcagcaca

SEQ ID NO: 839410 - DNA, 20 bp, mouse
gcccgtgtcccacaccgcct

SEQ ID NO: 839411 - DNA, 20 bp, mouse
gtgcagcacagggagcgcgc

SEQ ID NO: 839412 - DNA, 20 bp, mouse
gctgcagcagcgcacgtttc

SEQ ID NO: 839413 - DNA, 20 bp, mouse
ggcagcgcacgtttccggcc

SEQ ID NO: 839414 - DNA, 20 bp, mouse
ggggctgctggaagcctcaa

SEQ ID NO: 839415 - DNA, 20 bp, mouse
ggagaagccgggacacagac

SEQ ID NO: 839416 - DNA, 20 bp, mouse
gcgggaatggtagttctcag

SEQ ID NO: 839417 - DNA, 20 bp, mouse
gtaaaagtagacctggagct

SEQ ID NO: 839418 - DNA, 20 bp, mouse
ggaaggcgagcttcgaggtc

SEQ ID NO: 839419 - DNA, 20 bp, mouse
ggagcccgccctcaacgcag

SEQ ID NO: 839420 - DNA, 20 bp, mouse
gcagcctctgcgttgagggc

SEQ ID NO: 839421 - DNA, 20 bp, mouse
gcccgcccccgtgagcactc

SEQ ID NO: 839422 - DNA, 20 bp, mouse
gagctcgccttcctcgtcca

SEQ ID NO: 839423 - DNA, 20 bp, mouse
gggtctggtccctatggcaa

SEQ ID NO: 839424 - DNA, 20 bp, mouse
ggaagaataaagtgagaccg

SEQ ID NO: 839425 - DNA, 20 bp, mouse
gtgctggggtctggtcccta

SEQ ID NO: 839426 - DNA, 20 bp, mouse
gactctgcctctcctgaaaa

SEQ ID NO: 839427 - DNA, 20 bp, mouse
gtcctgaaaaggggtgtatg

SEQ ID NO: 839428 - DNA, 20 bp, mouse
gagtctatggtgacatttcc

SEQ ID NO: 839429 - DNA, 20 bp, mouse
gtgtatggggcagcagtgtc

SEQ ID NO: 839430 - DNA, 20 bp, mouse
ggccccatacaccccttttc

SEQ ID NO: 839431 - DNA, 20 bp, mouse
gggggcagcaggggcaaaga

SEQ ID NO: 839432 - DNA, 20 bp, mouse
gtggccgcaggcccgcccgc

SEQ ID NO: 839433 - DNA, 20 bp, mouse
gaaggctaatcagccttggg

SEQ ID NO: 839434 - DNA, 20 bp, mouse
gcagccttgggtggggccag

SEQ ID NO: 839435 - DNA, 20 bp, mouse
gcacaaaactcagtcacggg

SEQ ID NO: 839436 - DNA, 20 bp, mouse
gcagacattagggatatctc

SEQ ID NO: 839437 - DNA, 20 bp, mouse
gtacaggccaagaccaaaat

SEQ ID NO: 839438 - DNA, 20 bp, mouse
gcatgactgtgcagacatta

SEQ ID NO: 839439 - DNA, 20 bp, mouse
gtgtgaggagtcacatttta

SEQ ID NO: 839440 - DNA, 20 bp, mouse
gtgcacagaactgatctttt

SEQ ID NO: 839441 - DNA, 20 bp, mouse
gggccatgggtccagcatca

SEQ ID NO: 839442 - DNA, 20 bp, mouse
gcagatgtgactatagaagc

SEQ ID NO: 839443 - DNA, 20 bp, mouse
ggataccactgtgatcgcac

SEQ ID NO: 839444 - DNA, 20 bp, mouse
gtcctccagtgcgatcacag

SEQ ID NO: 839445 - DNA, 20 bp, mouse
gagacagaaagcatgtccct

SEQ ID NO: 839446 - DNA, 20 bp, mouse
gcatcccaaggaacctgtca

SEQ ID NO: 839447 - DNA, 20 bp, mouse
gacaggttccttgggatgta

SEQ ID NO: 839448 - DNA, 20 bp, mouse
gacagtgattactgatgagt

SEQ ID NO: 839449 - DNA, 20 bp, mouse
ggaatccatgacaggttcct

SEQ ID NO: 839450 - DNA, 20 bp, mouse
gagtgggtgggacgggacag

SEQ ID NO: 839451 - DNA, 20 bp, mouse
ggggacgcgcccacaggccc

SEQ ID NO: 839452 - DNA, 20 bp, mouse
gcgcgcccacaggcccgggg

SEQ ID NO: 839453 - DNA, 20 bp, mouse
gaaaccggttcctgtgtctc

SEQ ID NO: 839454 - DNA, 20 bp, mouse
gggcttgtccctacatccca

SEQ ID NO: 839455 - DNA, 20 bp, mouse
gcacactgagcactcggtcc

SEQ ID NO: 839456 - DNA, 20 bp, mouse
gtcctcgccaagtccggaca

SEQ ID NO: 839457 - DNA, 20 bp, mouse
gacttggcgaggacttggga

SEQ ID NO: 839458 - DNA, 20 bp, mouse
ggtaccgtcgtgggaatgga

SEQ ID NO: 839459 - DNA, 20 bp, mouse
gtctctctggggtgtcactc

SEQ ID NO: 839460 - DNA, 20 bp, mouse
gggagtgcaacaaatcaata

SEQ ID NO: 839461 - DNA, 20 bp, mouse
gcacccactaggacccaacc

SEQ ID NO: 839462 - DNA, 20 bp, mouse
ggggacaagaaacacccact

SEQ ID NO: 839463 - DNA, 20 bp, mouse
gaccggaggcggctccacaa

SEQ ID NO: 839464 - DNA, 20 bp, mouse
gcggccgctggctgccgggt

SEQ ID NO: 839465 - DNA, 20 bp, mouse
gtcagcgcatgctcggccgc

SEQ ID NO: 839466 - DNA, 20 bp, mouse
ggggcggggcgcgcgatcgg

SEQ ID NO: 839467 - DNA, 20 bp, mouse
ggggccccgagactgtctgg

SEQ ID NO: 839468 - DNA, 20 bp, mouse
ggctccctccagacagtctc

SEQ ID NO: 839469 - DNA, 20 bp, mouse
gggccactgctagggaacaa

SEQ ID NO: 839470 - DNA, 20 bp, mouse
gccacagtctcgtgagccag

SEQ ID NO: 839471 - DNA, 20 bp, mouse
ggcggccgcaggttgcagag

SEQ ID NO: 839472 - DNA, 20 bp, mouse
gtctggagggagccggcctc

SEQ ID NO: 839473 - DNA, 20 bp, mouse
gctctgctgttcacctggga

SEQ ID NO: 839474 - DNA, 20 bp, mouse
gtctcgccctgcactctgat

SEQ ID NO: 839475 - DNA, 20 bp, mouse
gagagggcggggctccacgc

SEQ ID NO: 839476 - DNA, 20 bp, mouse
ggcaatcagcggtgggatgt

SEQ ID NO: 839477 - DNA, 20 bp, mouse
gtgggaggggcaatcagcgg

SEQ ID NO: 839478 - DNA, 20 bp, mouse
gcacaggcggggcgtagaga

SEQ ID NO: 839479 - DNA, 20 bp, mouse
gggggaggagcaaagagcgg

SEQ ID NO: 839480 - DNA, 20 bp, mouse
ggggcggttcctgcatgggg

SEQ ID NO: 839481 - DNA, 20 bp, mouse
gtagggcggggtgcacggta

SEQ ID NO: 839482 - DNA, 20 bp, mouse
gtgggtgcgccagacgcact

SEQ ID NO: 839483 - DNA, 20 bp, mouse
gggggggaggagcgaaagat

SEQ ID NO: 839484 - DNA, 20 bp, mouse
gatggggcggttcctgcatg

SEQ ID NO: 839485 - DNA, 20 bp, mouse
gcgggggcggaacacaggcg

SEQ ID NO: 839486 - DNA, 20 bp, mouse
gtggagaggcgcaggagtaa

SEQ ID NO: 839487 - DNA, 20 bp, mouse
ggaggacaggatctatgcac

SEQ ID NO: 839488 - DNA, 20 bp, mouse
gggcttaggctacagtggac

SEQ ID NO: 839489 - DNA, 20 bp, mouse
gcagtggaccgggtgagaga

SEQ ID NO: 839490 - DNA, 20 bp, mouse
gagggggcgagactcaaaaa

SEQ ID NO: 839491 - DNA, 20 bp, mouse
gtggacgcgaaggggcgtgt

SEQ ID NO: 839492 - DNA, 20 bp, mouse
ggcagccaatggacgcgaag

SEQ ID NO: 839493 - DNA, 20 bp, mouse
gtattctaggggcgtggctt

SEQ ID NO: 839494 - DNA, 20 bp, mouse
ggccagggagcggacaatgc

SEQ ID NO: 839495 - DNA, 20 bp, mouse
gagtggagacagttaggagg

SEQ ID NO: 839496 - DNA, 20 bp, mouse
ggggccggagcgctgttgga

SEQ ID NO: 839497 - DNA, 20 bp, mouse
ggggtgtggactgacactgt

SEQ ID NO: 839498 - DNA, 20 bp, mouse
gttgactgggacggggtcgt

SEQ ID NO: 839499 - DNA, 20 bp, mouse
ggaggacagcggctaggcat

SEQ ID NO: 839500 - DNA, 20 bp, mouse
gtgtggactgacactgtggg

SEQ ID NO: 839501 - DNA, 20 bp, mouse
gggggcggagtcgtggttat

SEQ ID NO: 839502 - DNA, 20 bp, mouse
gggagggcggggtcggatga

SEQ ID NO: 839503 - DNA, 20 bp, mouse
gtccacaccccgccccagca

SEQ ID NO: 839504 - DNA, 20 bp, mouse
gcggagtcgtggttatgggc

SEQ ID NO: 839505 - DNA, 20 bp, mouse
gcgagaacagaagttagcta

SEQ ID NO: 839506 - DNA, 20 bp, mouse
gcggtgctggcgcgtctccg

SEQ ID NO: 839507 - DNA, 20 bp, mouse
gcgcgtctccggggcggaca

SEQ ID NO: 839508 - DNA, 20 bp, mouse
gtagtggcgacaggagacgg

SEQ ID NO: 839509 - DNA, 20 bp, mouse
gctaggacccggtgagagag

SEQ ID NO: 839510 - DNA, 20 bp, mouse
gtccacggccgctctctcac

SEQ ID NO: 839511 - DNA, 20 bp, mouse
gtaggagtgcagaggacatc

SEQ ID NO: 839512 - DNA, 20 bp, mouse
ggtcgccactactgccgccg

SEQ ID NO: 839513 - DNA, 20 bp, mouse
gactactgccgccgcggtgc

SEQ ID NO: 839514 - DNA, 20 bp, mouse
gggtcctagagcgtggtttc

SEQ ID NO: 839515 - DNA, 20 bp, mouse
gcccggtgagagagcggccg

SEQ ID NO: 839516 - DNA, 20 bp, mouse
gggcaggctcagtgaaaggg

SEQ ID NO: 839517 - DNA, 20 bp, mouse
gacagggcaggctcagtgaa

SEQ ID NO: 839518 - DNA, 20 bp, mouse
gggtgggtggaagcctaatt

SEQ ID NO: 839519 - DNA, 20 bp, mouse
gggcctcgtcccaagacaga

SEQ ID NO: 839520 - DNA, 20 bp, mouse
gtgccatgggcagactcccc

SEQ ID NO: 839521 - DNA, 20 bp, mouse
ggctcagtgaaaggggggtg

SEQ ID NO: 839522 - DNA, 20 bp, mouse
ggggctcataaacaagcaat

SEQ ID NO: 839523 - DNA, 20 bp, mouse
ggtcccaagacagacgggct

SEQ ID NO: 839524 - DNA, 20 bp, mouse
gactgagccatgaatatcca

SEQ ID NO: 839525 - DNA, 20 bp, mouse
ggggcaaggcagcatctggg

SEQ ID NO: 839526 - DNA, 20 bp, mouse
gaaggtggtgctacctccaa

SEQ ID NO: 839527 - DNA, 20 bp, mouse
gtgggaggggcgtgacctgt

SEQ ID NO: 839528 - DNA, 20 bp, mouse
gctacctccaagggccggag

SEQ ID NO: 839529 - DNA, 20 bp, mouse
gcacccgctccggcccttgg

SEQ ID NO: 839530 - DNA, 20 bp, mouse
gtggtctgcgggcggggatt

SEQ ID NO: 839531 - DNA, 20 bp, mouse
gcgccctggggtggagatcc

SEQ ID NO: 839532 - DNA, 20 bp, mouse
gctgtggctggggcgccctg

SEQ ID NO: 839533 - DNA, 20 bp, mouse
gcaccttcgtccacgctggt

SEQ ID NO: 839534 - DNA, 20 bp, mouse
ggagcccaagcccaccagcg

SEQ ID NO: 839535 - DNA, 20 bp, mouse
gagggccggagcgggtgcgt

SEQ ID NO: 839536 - DNA, 20 bp, mouse
gagaaaaggcgcggaggcgt

SEQ ID NO: 839537 - DNA, 20 bp, mouse
gaggtggcctcgcctcttaa

SEQ ID NO: 839538 - DNA, 20 bp, mouse
gagtgtagaatcctcttctg

SEQ ID NO: 839539 - DNA, 20 bp, mouse
gtacactcaaggacggtcag

SEQ ID NO: 839540 - DNA, 20 bp, mouse
ggaggccacctcgttctccg

SEQ ID NO: 839541 - DNA, 20 bp, mouse
gcaactaagtcccgcgtctg

SEQ ID NO: 839542 - DNA, 20 bp, mouse
gggccccctaggccgttccc

SEQ ID NO: 839543 - DNA, 20 bp, mouse
ggcctccgcgccttttcttc

SEQ ID NO: 839544 - DNA, 20 bp, mouse
gggggcggcgcgggggtctg

SEQ ID NO: 839545 - DNA, 20 bp, mouse
gtgcctgggaacggcctagg

SEQ ID NO: 839546 - DNA, 20 bp, mouse
gaagaaactaagggcaagac

SEQ ID NO: 839547 - DNA, 20 bp, mouse
ggggaaacacgggaaatcgg

SEQ ID NO: 839548 - DNA, 20 bp, mouse
gcaggcgcagagaattggtt

SEQ ID NO: 839549 - DNA, 20 bp, mouse
gaactaagggcaagactggg

SEQ ID NO: 839550 - DNA, 20 bp, mouse
gagcaggggtgggacggtgc

SEQ ID NO: 839551 - DNA, 20 bp, mouse
gttgcccttagtttcttcat

SEQ ID NO: 839552 - DNA, 20 bp, mouse
gcgcagagaattggtttggg

SEQ ID NO: 839553 - DNA, 20 bp, mouse
gcggtgcaggcgcagagaat

SEQ ID NO: 839554 - DNA, 20 bp, mouse
gggaacccgaggagatactc

SEQ ID NO: 839555 - DNA, 20 bp, mouse
gtgtctagaaaccctggcct

SEQ ID NO: 839556 - DNA, 20 bp, mouse
gagctcctgggtcttcagat

SEQ ID NO: 839557 - DNA, 20 bp, mouse
gacctggcagtcccagtctc

SEQ ID NO: 839558 - DNA, 20 bp, mouse
gtgtgcaaggactacccgga

SEQ ID NO: 839559 - DNA, 20 bp, mouse
gcccggaaggggtgctgctt

SEQ ID NO: 839560 - DNA, 20 bp, mouse
gggacccagaaccagtctga

SEQ ID NO: 839561 - DNA, 20 bp, mouse
gtcccaagcagcaccccttc

SEQ ID NO: 839562 - DNA, 20 bp, mouse
gagcctgggaaaacctaggt

SEQ ID NO: 839563 - DNA, 20 bp, mouse
gactggttctgggtccctgg

SEQ ID NO: 839564 - DNA, 20 bp, mouse
gccctggtggccacctttag

SEQ ID NO: 839565 - DNA, 20 bp, mouse
gtcgtctgcagtccctgacc

SEQ ID NO: 839566 - DNA, 20 bp, mouse
ggcaactgggcagaggacgt

SEQ ID NO: 839567 - DNA, 20 bp, mouse
gcccccgcctctcggaggag

SEQ ID NO: 839568 - DNA, 20 bp, mouse
gtgtctcccccgcctctcgg

SEQ ID NO: 839569 - DNA, 20 bp, mouse
gctgacttctcattggtcgg

SEQ ID NO: 839570 - DNA, 20 bp, mouse
gccccggacggccattggtg

SEQ ID NO: 839571 - DNA, 20 bp, mouse
gatccctctcctccgagagg

SEQ ID NO: 839572 - DNA, 20 bp, mouse
ggctggctgcttagtgacat

SEQ ID NO: 839573 - DNA, 20 bp, mouse
gtgagggacaacttgctaaa

SEQ ID NO: 839574 - DNA, 20 bp, mouse
gctcggaggagagggatggc

SEQ ID NO: 839575 - DNA, 20 bp, mouse
ggtgcacagcaactgggcag

SEQ ID NO: 839576 - DNA, 20 bp, mouse
gacacggaggggtgagacgg

SEQ ID NO: 839577 - DNA, 20 bp, mouse
gcggggctctggatcttacg

SEQ ID NO: 839578 - DNA, 20 bp, mouse
gactgggggcatgaagtcga

SEQ ID NO: 839579 - DNA, 20 bp, mouse
ggtgagacggcgggccgcgg

SEQ ID NO: 839580 - DNA, 20 bp, mouse
gcggaccgggagtgaaattg

SEQ ID NO: 839581 - DNA, 20 bp, mouse
gcaggcgcgcccatagcgcg

SEQ ID NO: 839582 - DNA, 20 bp, mouse
gacggcgggccgcgggggat

SEQ ID NO: 839583 - DNA, 20 bp, mouse
gctatgggcgcgcctggggc

SEQ ID NO: 839584 - DNA, 20 bp, mouse
gaatggggagggttctgcgg

SEQ ID NO: 839585 - DNA, 20 bp, mouse
gatcttacggggcggagcta

SEQ ID NO: 839586 - DNA, 20 bp, mouse
gtcaccctggacagcctccc

SEQ ID NO: 839587 - DNA, 20 bp, mouse
gaggtcgggaggggtctcct

SEQ ID NO: 839588 - DNA, 20 bp, mouse
gctgtccagggtgacatcgg

SEQ ID NO: 839589 - DNA, 20 bp, mouse
gtctgcacgtggctccatgg

SEQ ID NO: 839590 - DNA, 20 bp, mouse
gaggctgtccagggtgacat

SEQ ID NO: 839591 - DNA, 20 bp, mouse
ggtctcctgggtcttgagtg

SEQ ID NO: 839592 - DNA, 20 bp, mouse
ggggatggcaaaagctgcca

SEQ ID NO: 839593 - DNA, 20 bp, mouse
gggcaaggagctggtttctg

SEQ ID NO: 839594 - DNA, 20 bp, mouse
ggccagggcaggatgttggg

SEQ ID NO: 839595 - DNA, 20 bp, mouse
ggaaacaaacgatggagggg

SEQ ID NO: 839596 - DNA, 20 bp, mouse
ggcaaggggctcgggaagaa

SEQ ID NO: 839597 - DNA, 20 bp, mouse
ggtggcgcggctgcgtcgtg

SEQ ID NO: 839598 - DNA, 20 bp, mouse
gggctcgggaagaagggtcg

SEQ ID NO: 839599 - DNA, 20 bp, mouse
gacccgcagctcatccacgg

SEQ ID NO: 839600 - DNA, 20 bp, mouse
ggaccgcgacagaggtggcg

SEQ ID NO: 839601 - DNA, 20 bp, mouse
ggaagaagggtcggggagaa

SEQ ID NO: 839602 - DNA, 20 bp, mouse
ggggtccggtccctctgccc

SEQ ID NO: 839603 - DNA, 20 bp, mouse
ggcgtcgtgcggctgcctct

SEQ ID NO: 839604 - DNA, 20 bp, mouse
ggcgcgctcgactcgtgctc

SEQ ID NO: 839605 - DNA, 20 bp, mouse
gcagagggaccggacccccg

SEQ ID NO: 839606 - DNA, 20 bp, mouse
gctagagggtcattcttagg

SEQ ID NO: 839607 - DNA, 20 bp, mouse
gtttctagagggtcattctt

SEQ ID NO: 839608 - DNA, 20 bp, mouse
gttggaaggtccagcctccc

SEQ ID NO: 839609 - DNA, 20 bp, mouse
gactgagaagaaccggaaac

SEQ ID NO: 839610 - DNA, 20 bp, mouse
gacaggagacgattttctag

SEQ ID NO: 839611 - DNA, 20 bp, mouse
gctggaccttccaacattgc

SEQ ID NO: 839612 - DNA, 20 bp, mouse
gtccgattgttgcaactttc

SEQ ID NO: 839613 - DNA, 20 bp, mouse
gttcagtaacgatcagtagg

SEQ ID NO: 839614 - DNA, 20 bp, mouse
ggaaaatcgtctcctgtttc

SEQ ID NO: 839615 - DNA, 20 bp, mouse
gtgaagtaaaaaagactcgg

SEQ ID NO: 839616 - DNA, 20 bp, mouse
gcgcgcgccctgcagagctt

SEQ ID NO: 839617 - DNA, 20 bp, mouse
ggcccagcctgcgcgcgcac

SEQ ID NO: 839618 - DNA, 20 bp, mouse
gctctgcagggcgcgcgcga

SEQ ID NO: 839619 - DNA, 20 bp, mouse
gaacctgagagcctagaggc

SEQ ID NO: 839620 - DNA, 20 bp, mouse
ggcctcccaagtctgcaatc

SEQ ID NO: 839621 - DNA, 20 bp, mouse
gtcccgtgcgcgcgcaggct

SEQ ID NO: 839622 - DNA, 20 bp, mouse
gacttccagctgaagtcaga

SEQ ID NO: 839623 - DNA, 20 bp, mouse
ggccagattgcagacttggg

SEQ ID NO: 839624 - DNA, 20 bp, mouse
ggaaggagcaactaactgct

SEQ ID NO: 839625 - DNA, 20 bp, mouse
ggagcttcccgtgcgcgcgc

SEQ ID NO: 839626 - DNA, 20 bp, mouse
gtccgcagggttagaagaga

SEQ ID NO: 839627 - DNA, 20 bp, mouse
gaatggcacagcgagatagt

SEQ ID NO: 839628 - DNA, 20 bp, mouse
gggcacagcgagatagtagg

SEQ ID NO: 839629 - DNA, 20 bp, mouse
gtaaacagatatcaagttat

SEQ ID NO: 839630 - DNA, 20 bp, mouse
ggctgctaaggcattaggtc

SEQ ID NO: 839631 - DNA, 20 bp, mouse
gagtaggtggataggctggc

SEQ ID NO: 839632 - DNA, 20 bp, mouse
gagatagtaggtggataggc

SEQ ID NO: 839633 - DNA, 20 bp, mouse
gcaagttatgggagtggctg

SEQ ID NO: 839634 - DNA, 20 bp, mouse
gggaagtggcaggcatttaa

SEQ ID NO: 839635 - DNA, 20 bp, mouse
gcctggcagccgatttccgc

SEQ ID NO: 839636 - DNA, 20 bp, mouse
gtgggaggggcggacagaat

SEQ ID NO: 839637 - DNA, 20 bp, mouse
ggggcgggaccagtaagggg

SEQ ID NO: 839638 - DNA, 20 bp, mouse
gtccgagctgtgggaggacc

SEQ ID NO: 839639 - DNA, 20 bp, mouse
gcgggggcgggaccagtaag

SEQ ID NO: 839640 - DNA, 20 bp, mouse
ggaccaggcgtccgagctgt

SEQ ID NO: 839641 - DNA, 20 bp, mouse
gggcggacagaatggggacc

SEQ ID NO: 839642 - DNA, 20 bp, mouse
gcctcctggggctggaccga

SEQ ID NO: 839643 - DNA, 20 bp, mouse
ggaaagaggcgaaggcctca

SEQ ID NO: 839644 - DNA, 20 bp, mouse
gaggggagccccctccacaa

SEQ ID NO: 839645 - DNA, 20 bp, mouse
gactccctccagtgcttacg

SEQ ID NO: 839646 - DNA, 20 bp, mouse
gaggtgggcagggtctgaga

SEQ ID NO: 839647 - DNA, 20 bp, mouse
ggtggtcctaactggagagt

SEQ ID NO: 839648 - DNA, 20 bp, mouse
gcccagaagtgctactggat

SEQ ID NO: 839649 - DNA, 20 bp, mouse
gaaggacaggcaaggccaat

SEQ ID NO: 839650 - DNA, 20 bp, mouse
gccaatggggtgagacaaat

SEQ ID NO: 839651 - DNA, 20 bp, mouse
ggtgagacaaataggaagga

SEQ ID NO: 839652 - DNA, 20 bp, mouse
gaaggagggcggagctaagg

SEQ ID NO: 839653 - DNA, 20 bp, mouse
gggaggagggtggtcctaac

SEQ ID NO: 839654 - DNA, 20 bp, mouse
ggtcctaactggagagtggg

SEQ ID NO: 839655 - DNA, 20 bp, mouse
gtaaaccaaaccaggccaga

SEQ ID NO: 839656 - DNA, 20 bp, mouse
gtcgtgggcctggacacaga

SEQ ID NO: 839657 - DNA, 20 bp, mouse
gcggggcgaggcggggtcag

SEQ ID NO: 839658 - DNA, 20 bp, mouse
gacaacgaatgccacagagg

SEQ ID NO: 839659 - DNA, 20 bp, mouse
gggagagatgcatcgcagac

SEQ ID NO: 839660 - DNA, 20 bp, mouse
gcaaacatgtgccacctctg

SEQ ID NO: 839661 - DNA, 20 bp, mouse
gcccaggcccgccctcaacc

SEQ ID NO: 839662 - DNA, 20 bp, mouse
gtgtgtccaggcccacgatg

SEQ ID NO: 839663 - DNA, 20 bp, mouse
gcagacaacgaatgccacag

SEQ ID NO: 839664 - DNA, 20 bp, mouse
gcctgtgagtcaattagagt

SEQ ID NO: 839665 - DNA, 20 bp, mouse
gaaaatacggataagatgat

SEQ ID NO: 839666 - DNA, 20 bp, mouse
gaaaaggagaagttccatgg

SEQ ID NO: 839667 - DNA, 20 bp, mouse
gcgtgagagcccgagatacg

SEQ ID NO: 839668 - DNA, 20 bp, mouse
gcaggaaggagctgaagtga

SEQ ID NO: 839669 - DNA, 20 bp, mouse
gcgaggaattaaatgagccc

SEQ ID NO: 839670 - DNA, 20 bp, mouse
gagagagcatgggtaccagt

SEQ ID NO: 839671 - DNA, 20 bp, mouse
ggtccagatctcaccatcaa

SEQ ID NO: 839672 - DNA, 20 bp, mouse
gacccagttctgtgtccctg

SEQ ID NO: 839673 - DNA, 20 bp, mouse
gcagaggcaggccaaccagg

SEQ ID NO: 839674 - DNA, 20 bp, mouse
gcctggagccacagtccaac

SEQ ID NO: 839675 - DNA, 20 bp, mouse
gaggctgggctctttacgga

SEQ ID NO: 839676 - DNA, 20 bp, mouse
gaacctgcagcgcacctgat

SEQ ID NO: 839677 - DNA, 20 bp, mouse
ggagactgaagacagtggcg

SEQ ID NO: 839678 - DNA, 20 bp, mouse
gggcgaagggtccagaagcc

SEQ ID NO: 839679 - DNA, 20 bp, mouse
gacgagctgaagaaccaatc

SEQ ID NO: 839680 - DNA, 20 bp, mouse
gcagcccggatgcgggcgaa

SEQ ID NO: 839681 - DNA, 20 bp, mouse
gcgtgacttccgtatttgtt

SEQ ID NO: 839682 - DNA, 20 bp, mouse
gcgctggagagagcgagggg

SEQ ID NO: 839683 - DNA, 20 bp, mouse
gactgcgctggagagagcga

SEQ ID NO: 839684 - DNA, 20 bp, mouse
gaaccaatcaggtgcgctgc

SEQ ID NO: 839685 - DNA, 20 bp, mouse
gcctaggagactgaagacag

SEQ ID NO: 839686 - DNA, 20 bp, mouse
ggggcagtcagcctgatgat

SEQ ID NO: 839687 - DNA, 20 bp, mouse
gttcgcgcccaccaatcatc

SEQ ID NO: 839688 - DNA, 20 bp, mouse
gactgcccctcagtgatgag

SEQ ID NO: 839689 - DNA, 20 bp, mouse
gaacgctaccgccagctccg

SEQ ID NO: 839690 - DNA, 20 bp, mouse
ggatgtgtagtgttggcaag

SEQ ID NO: 839691 - DNA, 20 bp, mouse
gggagtggggcaggcgctgt

SEQ ID NO: 839692 - DNA, 20 bp, mouse
gtgggcggggcctgggcgat

SEQ ID NO: 839693 - DNA, 20 bp, mouse
gaagcggattgcgtgagaga

SEQ ID NO: 839694 - DNA, 20 bp, mouse
ggataggcgctgtgggagtg

SEQ ID NO: 839695 - DNA, 20 bp, mouse
gacaagactaggcccgggga

SEQ ID NO: 839696 - DNA, 20 bp, mouse
gaactggttccaggttagaa

SEQ ID NO: 839697 - DNA, 20 bp, mouse
gaaagccagcacaacacggg

SEQ ID NO: 839698 - DNA, 20 bp, mouse
gctaaagctgcaaagagcca

SEQ ID NO: 839699 - DNA, 20 bp, mouse
gtgctgggctggtatagact

SEQ ID NO: 839700 - DNA, 20 bp, mouse
gcactccactgcaggagaca

SEQ ID NO: 839701 - DNA, 20 bp, mouse
gagcccaggccatcggacaa

SEQ ID NO: 839702 - DNA, 20 bp, mouse
gcaaccctcccgtgttgtgc

SEQ ID NO: 839703 - DNA, 20 bp, mouse
gagagcaggcattaggagtc

SEQ ID NO: 839704 - DNA, 20 bp, mouse
ggactctagcaagtcacatc

SEQ ID NO: 839705 - DNA, 20 bp, mouse
gcaaccacatctgctgagtt

SEQ ID NO: 839706 - DNA, 20 bp, mouse
ggggaaattgagtacataaa

SEQ ID NO: 839707 - DNA, 20 bp, mouse
gcatggcaacctgtgacgtc

SEQ ID NO: 839708 - DNA, 20 bp, mouse
gataaggagggcctgtgagc

SEQ ID NO: 839709 - DNA, 20 bp, mouse
gcaccagcccagaaggaaaa

SEQ ID NO: 839710 - DNA, 20 bp, mouse
ggcgcgagaactggcaatcc

SEQ ID NO: 839711 - DNA, 20 bp, mouse
gaattcgcttctctattcct

SEQ ID NO: 839712 - DNA, 20 bp, mouse
gattgccagttctcgcgcta

SEQ ID NO: 839713 - DNA, 20 bp, mouse
gctaaccgtagcgcgagaac

SEQ ID NO: 839714 - DNA, 20 bp, mouse
gtctgtgtccgaaataagga

SEQ ID NO: 839715 - DNA, 20 bp, mouse
gcgctacggttagttgcagc

SEQ ID NO: 839716 - DNA, 20 bp, mouse
gatagcaagcgtgtccccag

SEQ ID NO: 839717 - DNA, 20 bp, mouse
ggcgtgtagcatgtgagggt

SEQ ID NO: 839718 - DNA, 20 bp, mouse
gacccactgcacccagtgat

SEQ ID NO: 839719 - DNA, 20 bp, mouse
gtaagggcgtgtagcatgtg

SEQ ID NO: 839720 - DNA, 20 bp, mouse
gtaccaaggccaagcacagg

SEQ ID NO: 839721 - DNA, 20 bp, mouse
gcacgcttgctatcaatgat

SEQ ID NO: 839722 - DNA, 20 bp, mouse
gaactgcaaaataagactaa

SEQ ID NO: 839723 - DNA, 20 bp, mouse
gccagcttcgtagagaccct

SEQ ID NO: 839724 - DNA, 20 bp, mouse
gctggtacgcagccgctgag

SEQ ID NO: 839725 - DNA, 20 bp, mouse
gtacgaagctggcctctcca

SEQ ID NO: 839726 - DNA, 20 bp, mouse
gtcagcagaggactgcagcg

SEQ ID NO: 839727 - DNA, 20 bp, mouse
gatgtcggcgacccggagga

SEQ ID NO: 839728 - DNA, 20 bp, mouse
gggccctggggacggacttc

SEQ ID NO: 839729 - DNA, 20 bp, mouse
gagcctgaagtccgtcccca

SEQ ID NO: 839730 - DNA, 20 bp, mouse
gctcagggcgctgcgcttgc

SEQ ID NO: 839731 - DNA, 20 bp, mouse
gcgcttcagttgcatcacgt

SEQ ID NO: 839732 - DNA, 20 bp, mouse
gcgctgcgcttgcaggctgg

SEQ ID NO: 839733 - DNA, 20 bp, mouse
ggggcgctgcgcttgcaggc

SEQ ID NO: 839734 - DNA, 20 bp, mouse
gggaaacgctcgggtccgcc

SEQ ID NO: 839735 - DNA, 20 bp, mouse
gggaagtcttcgccctcctc

SEQ ID NO: 839736 - DNA, 20 bp, mouse
gaacctggagcagagtactt

SEQ ID NO: 839737 - DNA, 20 bp, mouse
gcagtgggaaacgccatcag

SEQ ID NO: 839738 - DNA, 20 bp, mouse
gaaaggagaaaagaatagcg

SEQ ID NO: 839739 - DNA, 20 bp, mouse
gtctctagttccatcctgta

SEQ ID NO: 839740 - DNA, 20 bp, mouse
gggcagcaagaccagaacag

SEQ ID NO: 839741 - DNA, 20 bp, mouse
gtgaggtcgccctagcgatt

SEQ ID NO: 839742 - DNA, 20 bp, mouse
ggtcttgctgccagccagat

SEQ ID NO: 839743 - DNA, 20 bp, mouse
gtggtagcatctaccactga

SEQ ID NO: 839744 - DNA, 20 bp, mouse
gtcgctagggcgacctcacc

SEQ ID NO: 839745 - DNA, 20 bp, mouse
gtaattattaggatttactg

SEQ ID NO: 839746 - DNA, 20 bp, mouse
gttgctggggctcgcgtcgc

SEQ ID NO: 839747 - DNA, 20 bp, mouse
ggctcgcgtcgcagggtcag

SEQ ID NO: 839748 - DNA, 20 bp, mouse
gccctgcggagcggggagag

SEQ ID NO: 839749 - DNA, 20 bp, mouse
gggcgcgggccctgcggagc

SEQ ID NO: 839750 - DNA, 20 bp, mouse
gtggccgaggtgctgactga

SEQ ID NO: 839751 - DNA, 20 bp, mouse
gggcccgcgccggcatgtgc

SEQ ID NO: 839752 - DNA, 20 bp, mouse
ggagaccctaggagcaatgg

SEQ ID NO: 839753 - DNA, 20 bp, mouse
gtggcttcctgatgttgctg

SEQ ID NO: 839754 - DNA, 20 bp, mouse
ggatcacggtcctgcggctt

SEQ ID NO: 839755 - DNA, 20 bp, mouse
ggcgcggggggctatgtgcg

SEQ ID NO: 839756 - DNA, 20 bp, mouse
gggcccggagcaaaagcagc

SEQ ID NO: 839757 - DNA, 20 bp, mouse
gtttcaggcggggaatgaat

SEQ ID NO: 839758 - DNA, 20 bp, mouse
gcgggaatggacgtccatca

SEQ ID NO: 839759 - DNA, 20 bp, mouse
gacccagaccggctccctga

SEQ ID NO: 839760 - DNA, 20 bp, mouse
gagcagctacaggagatcct

SEQ ID NO: 839761 - DNA, 20 bp, mouse
ggataagagcgccgccctga

SEQ ID NO: 839762 - DNA, 20 bp, mouse
gctgccattggccaccgggg

SEQ ID NO: 839763 - DNA, 20 bp, mouse
gagatcctgggttggaaggc

SEQ ID NO: 839764 - DNA, 20 bp, mouse
ggaacttgagggagcagcgc

SEQ ID NO: 839765 - DNA, 20 bp, mouse
gatgacgcgacgaagaaaac

SEQ ID NO: 839766 - DNA, 20 bp, mouse
ggctaactgccaatcgcaaa

SEQ ID NO: 839767 - DNA, 20 bp, mouse
gaacccgagcgagactggac

SEQ ID NO: 839768 - DNA, 20 bp, mouse
gttgttaaggttacaagtcc

SEQ ID NO: 839769 - DNA, 20 bp, mouse
gttcccgcctaatgtcagcc

SEQ ID NO: 839770 - DNA, 20 bp, mouse
gcggttcccacaatactcca

SEQ ID NO: 839771 - DNA, 20 bp, mouse
ggtcctgtccagtctcgctc

SEQ ID NO: 839772 - DNA, 20 bp, mouse
ggtcccggctgacattaggc

SEQ ID NO: 839773 - DNA, 20 bp, mouse
gacaagtcccggctgacatt

SEQ ID NO: 839774 - DNA, 20 bp, mouse
gcgggaacccattgccttct

SEQ ID NO: 839775 - DNA, 20 bp, mouse
ggaaaggcggcagggtattg

SEQ ID NO: 839776 - DNA, 20 bp, mouse
ggaagactgtacacgaaaca

SEQ ID NO: 839777 - DNA, 20 bp, mouse
gctccagcctgaggtgagag

SEQ ID NO: 839778 - DNA, 20 bp, mouse
gtctcccaggtgacttcagt

SEQ ID NO: 839779 - DNA, 20 bp, mouse
gcataagcctctctcacctc

SEQ ID NO: 839780 - DNA, 20 bp, mouse
gtcagtctgctccagtacac

SEQ ID NO: 839781 - DNA, 20 bp, mouse
gtgcctgggccgattgaact

SEQ ID NO: 839782 - DNA, 20 bp, mouse
gctagagtcttgggcctctt

SEQ ID NO: 839783 - DNA, 20 bp, mouse
gctagggcatccagtgtggg

SEQ ID NO: 839784 - DNA, 20 bp, mouse
ggatctgctctacagtggca

SEQ ID NO: 839785 - DNA, 20 bp, mouse
gacaaaggagtaatgccctg

SEQ ID NO: 839786 - DNA, 20 bp, mouse
ggaagccaggaaggcctaga

SEQ ID NO: 839787 - DNA, 20 bp, mouse
gtcattccagtgggtaggga

SEQ ID NO: 839788 - DNA, 20 bp, mouse
ggacctgtaccgcttctctc

SEQ ID NO: 839789 - DNA, 20 bp, mouse
gaagctggcattcagacttg

SEQ ID NO: 839790 - DNA, 20 bp, mouse
gccttcctggcttccatcca

SEQ ID NO: 839791 - DNA, 20 bp, mouse
gacagcaagaaaaagggcca

SEQ ID NO: 839792 - DNA, 20 bp, mouse
gagcttcattccagtgggta

SEQ ID NO: 839793 - DNA, 20 bp, mouse
ggcccagagagaagcggtac

SEQ ID NO: 839794 - DNA, 20 bp, mouse
gtgctccttctaggccttcc

SEQ ID NO: 839795 - DNA, 20 bp, mouse
gggggaatgggacccctgga

SEQ ID NO: 839796 - DNA, 20 bp, mouse
gaggcgggccttctccatgt

SEQ ID NO: 839797 - DNA, 20 bp, mouse
gcagagtggtagcgatgctg

SEQ ID NO: 839798 - DNA, 20 bp, mouse
gggtagcgatgctggggaac

SEQ ID NO: 839799 - DNA, 20 bp, mouse
gtgggtggccgcgtaggtca

SEQ ID NO: 839800 - DNA, 20 bp, mouse
ggcccgggccccagcgtcga

SEQ ID NO: 839801 - DNA, 20 bp, mouse
gagctggatggggacttcgg

SEQ ID NO: 839802 - DNA, 20 bp, mouse
gcacgggcagggagcatcta

SEQ ID NO: 839803 - DNA, 20 bp, mouse
gcctggaagcggagcccaca

SEQ ID NO: 839804 - DNA, 20 bp, mouse
gagaggccgaggccggtccc

SEQ ID NO: 839805 - DNA, 20 bp, mouse
gcgcgcagcagacacctgcc

SEQ ID NO: 839806 - DNA, 20 bp, mouse
ggccacagagggaacttacc

SEQ ID NO: 839807 - DNA, 20 bp, mouse
gttactgagtatctgccatg

SEQ ID NO: 839808 - DNA, 20 bp, mouse
gtaacatagaggagccacag

SEQ ID NO: 839809 - DNA, 20 bp, mouse
gcttgaaatgaagtgcagtt

SEQ ID NO: 839810 - DNA, 20 bp, mouse
gcagcgtgagaaacatgtca

SEQ ID NO: 839811 - DNA, 20 bp, mouse
gacctggtaagttccctctg

SEQ ID NO: 839812 - DNA, 20 bp, mouse
gtagaagcatgggtactctg

SEQ ID NO: 839813 - DNA, 20 bp, mouse
gtgtggccaatgatgaataa

SEQ ID NO: 839814 - DNA, 20 bp, mouse
gcagtggatgagtgactaaa

SEQ ID NO: 839815 - DNA, 20 bp, mouse
gaataaaggtgtatggaact

SEQ ID NO: 839816 - DNA, 20 bp, mouse
gagtatgaagggctagcact

SEQ ID NO: 839817 - DNA, 20 bp, mouse
gactaggatgtggctttggg

SEQ ID NO: 839818 - DNA, 20 bp, mouse
gcttaagaggatacctttga

SEQ ID NO: 839819 - DNA, 20 bp, mouse
gtagcactaggatgtggctt

SEQ ID NO: 839820 - DNA, 20 bp, mouse
gagagatgacagggcttaag

SEQ ID NO: 839821 - DNA, 20 bp, mouse
gaggagggttgagtcttcta

SEQ ID NO: 839822 - DNA, 20 bp, mouse
ggaagaacccagcattgggt

SEQ ID NO: 839823 - DNA, 20 bp, mouse
gggctaatccagagatgaca

SEQ ID NO: 839824 - DNA, 20 bp, mouse
gtattcaatcgcatgcagag

SEQ ID NO: 839825 - DNA, 20 bp, mouse
gagggggtgcaaagcctccg

SEQ ID NO: 839826 - DNA, 20 bp, mouse
gggctccctaaacccttctt

SEQ ID NO: 839827 - DNA, 20 bp, mouse
gcacgaggaactgaccatta

SEQ ID NO: 839828 - DNA, 20 bp, mouse
gtgaagtgatggtgctcagg

SEQ ID NO: 839829 - DNA, 20 bp, mouse
gagggagggtccccgcccca

SEQ ID NO: 839830 - DNA, 20 bp, mouse
ggcgggtcctgcaagtatgg

SEQ ID NO: 839831 - DNA, 20 bp, mouse
gcgggcgtcactcggccttg

SEQ ID NO: 839832 - DNA, 20 bp, mouse
ggggccgtagccccctggcg

SEQ ID NO: 839833 - DNA, 20 bp, mouse
gtagccaggctcgaggcaac

SEQ ID NO: 839834 - DNA, 20 bp, mouse
gaggacatgcccccgccagg

SEQ ID NO: 839835 - DNA, 20 bp, mouse
ggcctcgagcctggctacca

SEQ ID NO: 839836 - DNA, 20 bp, mouse
ggtggagcaggctttcccta

SEQ ID NO: 839837 - DNA, 20 bp, mouse
gccctcctaggcaccagaaa

SEQ ID NO: 839838 - DNA, 20 bp, mouse
ggggagggcgccggggaagt

SEQ ID NO: 839839 - DNA, 20 bp, mouse
ggaggttggcacattcccta

SEQ ID NO: 839840 - DNA, 20 bp, mouse
gactatagcagcaaattggt

SEQ ID NO: 839841 - DNA, 20 bp, mouse
gcaccagaaagggagggcgc

SEQ ID NO: 839842 - DNA, 20 bp, mouse
ggactcacagtgggagaggt

SEQ ID NO: 839843 - DNA, 20 bp, mouse
ggtaatcagtgcgcccggag

SEQ ID NO: 839844 - DNA, 20 bp, mouse
gggaggcggtacaatggtgc

SEQ ID NO: 839845 - DNA, 20 bp, mouse
gcaccgcactcagccctctc

SEQ ID NO: 839846 - DNA, 20 bp, mouse
gaaaccgagtcctgtgggcg

SEQ ID NO: 839847 - DNA, 20 bp, mouse
gagaccctcccggggaactc

SEQ ID NO: 839848 - DNA, 20 bp, mouse
gccgccccgcccacaggact

SEQ ID NO: 839849 - DNA, 20 bp, mouse
gtaaccactagagtgtgtct

SEQ ID NO: 839850 - DNA, 20 bp, mouse
gctgggaaaccgagtcctgt

SEQ ID NO: 839851 - DNA, 20 bp, mouse
gcagcccactagtcccttga

SEQ ID NO: 839852 - DNA, 20 bp, mouse
gggtccctcaagggactagt

SEQ ID NO: 839853 - DNA, 20 bp, mouse
gtattcccggttcaagtgga

SEQ ID NO: 839854 - DNA, 20 bp, mouse
gtgcaccggaagtagctctt

SEQ ID NO: 839855 - DNA, 20 bp, mouse
ggcagttccagcggtgagac

SEQ ID NO: 839856 - DNA, 20 bp, mouse
ggactctgggtaatgagtat

SEQ ID NO: 839857 - DNA, 20 bp, mouse
gacagcagcaccccactcaa

SEQ ID NO: 839858 - DNA, 20 bp, mouse
ggaagcaagggcatggcccc

SEQ ID NO: 839859 - DNA, 20 bp, mouse
gggcacaggcaccaggactc

SEQ ID NO: 839860 - DNA, 20 bp, mouse
gttcccccagggccccaaaa

SEQ ID NO: 839861 - DNA, 20 bp, mouse
gtaggccggaaatttcaccc

SEQ ID NO: 839862 - DNA, 20 bp, mouse
gggaggaagacagacaactg

SEQ ID NO: 839863 - DNA, 20 bp, mouse
gcagccgaggcccctacgga

SEQ ID NO: 839864 - DNA, 20 bp, mouse
gccagagcccaaccagagac

SEQ ID NO: 839865 - DNA, 20 bp, mouse
ggctgggtcaacctttgagt

SEQ ID NO: 839866 - DNA, 20 bp, mouse
gagggctcggggagccccaa

SEQ ID NO: 839867 - DNA, 20 bp, mouse
ggggctccgcagtggaaggc

SEQ ID NO: 839868 - DNA, 20 bp, mouse
gccggggggcgtgggctcga

SEQ ID NO: 839869 - DNA, 20 bp, mouse
gcggcagcccgacggttctg

SEQ ID NO: 839870 - DNA, 20 bp, mouse
gccgccgggaaaatcccgcc

SEQ ID NO: 839871 - DNA, 20 bp, mouse
ggcccctgcgccgacgactt

SEQ ID NO: 839872 - DNA, 20 bp, mouse
gtgtccagaagggcccgggg

SEQ ID NO: 839873 - DNA, 20 bp, mouse
gggcctgtataaagccgagg

SEQ ID NO: 839874 - DNA, 20 bp, mouse
ggcccggggtggaaagccgg

SEQ ID NO: 839875 - DNA, 20 bp, mouse
gagccgaggcgggatcgctg

SEQ ID NO: 839876 - DNA, 20 bp, mouse
ggagagaagggcaaatgata

SEQ ID NO: 839877 - DNA, 20 bp, mouse
gagccagcaccggcagaaag

SEQ ID NO: 839878 - DNA, 20 bp, mouse
gtgaatgtaaaggcccttag

SEQ ID NO: 839879 - DNA, 20 bp, mouse
ggcaggaaggagccgaggaa

SEQ ID NO: 839880 - DNA, 20 bp, mouse
gtctgccggtgctggctgcg

SEQ ID NO: 839881 - DNA, 20 bp, mouse
ggaccaggagccaagaaatg

SEQ ID NO: 839882 - DNA, 20 bp, mouse
gagggcttacagtagatgca

SEQ ID NO: 839883 - DNA, 20 bp, mouse
gaggaagtggtcagcagccc

SEQ ID NO: 839884 - DNA, 20 bp, mouse
gttgaagacaggtaaagacc

SEQ ID NO: 839885 - DNA, 20 bp, mouse
gtgcggggcgctcaagagcc

SEQ ID NO: 839886 - DNA, 20 bp, mouse
ggagcctcgggtattgggaa

SEQ ID NO: 839887 - DNA, 20 bp, mouse
gggaaactggaagggtagat

SEQ ID NO: 839888 - DNA, 20 bp, mouse
gtggggtggggtcaagttga

SEQ ID NO: 839889 - DNA, 20 bp, mouse
gtggttgggaaccagtagat

SEQ ID NO: 839890 - DNA, 20 bp, mouse
gctggagagcctcgggtatt

SEQ ID NO: 839891 - DNA, 20 bp, mouse
gcctaaatgcctatcttcca

SEQ ID NO: 839892 - DNA, 20 bp, mouse
gtctgtgatctagtgagtat

SEQ ID NO: 839893 - DNA, 20 bp, mouse
gacagaggtgtgtcattctc

SEQ ID NO: 839894 - DNA, 20 bp, mouse
ggtaggaaggggacagtggt

SEQ ID NO: 839895 - DNA, 20 bp, mouse
ggcaggcagtggtgtaggaa

SEQ ID NO: 839896 - DNA, 20 bp, mouse
ggcggtggggcggtgatgtc

SEQ ID NO: 839897 - DNA, 20 bp, mouse
ggggaccaggtgagtctagt

SEQ ID NO: 839898 - DNA, 20 bp, mouse
ggagcctatggtcaagtgaa

SEQ ID NO: 839899 - DNA, 20 bp, mouse
gagttcccgggcagagtcta

SEQ ID NO: 839900 - DNA, 20 bp, mouse
gtcccgggcagagtctaggg

SEQ ID NO: 839901 - DNA, 20 bp, mouse
gctgcccgggaactctcata

SEQ ID NO: 839902 - DNA, 20 bp, mouse
gagaccatatgagagttccc

SEQ ID NO: 839903 - DNA, 20 bp, mouse
gacggcggcggctgcgaagt

SEQ ID NO: 839904 - DNA, 20 bp, mouse
gcagagtggaacgtgatgtc

SEQ ID NO: 839905 - DNA, 20 bp, mouse
ggggaagtacagtggctatg

SEQ ID NO: 839906 - DNA, 20 bp, mouse
gaggaagggggcggagaatt

SEQ ID NO: 839907 - DNA, 20 bp, mouse
gtcccattgcctatcaggaa

SEQ ID NO: 839908 - DNA, 20 bp, mouse
gctccaatcagcacccgcgg

SEQ ID NO: 839909 - DNA, 20 bp, mouse
ggcggcaattctccggtggg

SEQ ID NO: 839910 - DNA, 20 bp, mouse
gactagccaaccgacgccac

SEQ ID NO: 839911 - DNA, 20 bp, mouse
gaggctgtgcggcttgcggg

SEQ ID NO: 839912 - DNA, 20 bp, mouse
gtgtcctgaggagagatgta

SEQ ID NO: 839913 - DNA, 20 bp, mouse
gcccagcctgtggcgtcggt

SEQ ID NO: 839914 - DNA, 20 bp, mouse
gagcacccgcggcggagagg

SEQ ID NO: 839915 - DNA, 20 bp, mouse
ggaagatagcggcaattctc

SEQ ID NO: 839916 - DNA, 20 bp, mouse
gtaactcaagatgacagctg

SEQ ID NO: 839917 - DNA, 20 bp, mouse
ggctgtgtgacgtcactgta

SEQ ID NO: 839918 - DNA, 20 bp, mouse
gtagggacgaaggatgtttt

SEQ ID NO: 839919 - DNA, 20 bp, mouse
gttctggcgtccctcatgtt

SEQ ID NO: 839920 - DNA, 20 bp, mouse
gccggaagtgcacctgactc

SEQ ID NO: 839921 - DNA, 20 bp, mouse
gccgctcactctcttcgagt

SEQ ID NO: 839922 - DNA, 20 bp, mouse
gatgcacattcctaacatga

SEQ ID NO: 839923 - DNA, 20 bp, mouse
gtggccaatggcgccattgc

SEQ ID NO: 839924 - DNA, 20 bp, mouse
gactgtacagcgctttccag

SEQ ID NO: 839925 - DNA, 20 bp, mouse
gttgccagcaatggcgccat

SEQ ID NO: 839926 - DNA, 20 bp, mouse
gaaccctcgcggctccagag

SEQ ID NO: 839927 - DNA, 20 bp, mouse
ggcgctgccccgtttgaagc

SEQ ID NO: 839928 - DNA, 20 bp, mouse
gcaaagagacggtactgcct

SEQ ID NO: 839929 - DNA, 20 bp, mouse
gcgtacttcggtgtgagtcc

SEQ ID NO: 839930 - DNA, 20 bp, mouse
ggtcccacccagaagcaagt

SEQ ID NO: 839931 - DNA, 20 bp, mouse
gcacaccgaagtacgctgga

SEQ ID NO: 839932 - DNA, 20 bp, mouse
gttccactctggagccgcga

SEQ ID NO: 839933 - DNA, 20 bp, mouse
gcaccaacttgcttctgggt

SEQ ID NO: 839934 - DNA, 20 bp, mouse
gacggggcagcgcgttcttt

SEQ ID NO: 839935 - DNA, 20 bp, mouse
ggggacatcccagcttcaaa

SEQ ID NO: 839936 - DNA, 20 bp, mouse
ggggcggggcgcggctagga

SEQ ID NO: 839937 - DNA, 20 bp, mouse
gtccgccagcggccggaagc

SEQ ID NO: 839938 - DNA, 20 bp, mouse
gaagacgcctggactggcct

SEQ ID NO: 839939 - DNA, 20 bp, mouse
gcccttgggtgcccctccca

SEQ ID NO: 839940 - DNA, 20 bp, mouse
ggccgctggcggaagacgcc

SEQ ID NO: 839941 - DNA, 20 bp, mouse
ggcactcgatacaacgatac

SEQ ID NO: 839942 - DNA, 20 bp, mouse
gggagccctagagtggccat

SEQ ID NO: 839943 - DNA, 20 bp, mouse
gagtggccatggggaccggc

SEQ ID NO: 839944 - DNA, 20 bp, mouse
gcgcagccgcagtacccgct

SEQ ID NO: 839945 - DNA, 20 bp, mouse
gcatggggaccggcgggcgt

SEQ ID NO: 839946 - DNA, 20 bp, mouse
gaggaagcgcgaagcgggtc

SEQ ID NO: 839947 - DNA, 20 bp, mouse
ggcggcgcccgcgtcccctc

SEQ ID NO: 839948 - DNA, 20 bp, mouse
ggccgagggcggagtaaggc

SEQ ID NO: 839949 - DNA, 20 bp, mouse
gcacccggtgaaaaagagac

SEQ ID NO: 839950 - DNA, 20 bp, mouse
ggaagcgggtctggcgccga

SEQ ID NO: 839951 - DNA, 20 bp, mouse
gaggctggaggtgtgacgtg

SEQ ID NO: 839952 - DNA, 20 bp, mouse
gtcccctcaggattgcctca

SEQ ID NO: 839953 - DNA, 20 bp, mouse
gtggcgccgagggcggagta

SEQ ID NO: 839954 - DNA, 20 bp, mouse
gaccttgaggcaatcctgag

SEQ ID NO: 839955 - DNA, 20 bp, mouse
gggcgccgccccgggcagac

SEQ ID NO: 839956 - DNA, 20 bp, mouse
ggggcagtgcacgccgacgc

SEQ ID NO: 839957 - DNA, 20 bp, mouse
gccgccccgcagagacatgg

SEQ ID NO: 839958 - DNA, 20 bp, mouse
gcaagccaaggcctaagtca

SEQ ID NO: 839959 - DNA, 20 bp, mouse
gggtaccagccctcgagcaa

SEQ ID NO: 839960 - DNA, 20 bp, mouse
gacagggtgacgcgtcgcgg

SEQ ID NO: 839961 - DNA, 20 bp, mouse
ggtccagcgacgcccaatcc

SEQ ID NO: 839962 - DNA, 20 bp, mouse
gtgcacgccgacgcgggcca

SEQ ID NO: 839963 - DNA, 20 bp, mouse
gcatacagggtgacgcgtcg

SEQ ID NO: 839964 - DNA, 20 bp, mouse
ggcgggcccgggcgagtgtc

SEQ ID NO: 839965 - DNA, 20 bp, mouse
gttgctcggcctttgctcga

SEQ ID NO: 839966 - DNA, 20 bp, mouse
gagtgcctcggagacgatac

SEQ ID NO: 839967 - DNA, 20 bp, mouse
gttccccgaccgagagtaaa

SEQ ID NO: 839968 - DNA, 20 bp, mouse
gtactctcggtcggggaagc

SEQ ID NO: 839969 - DNA, 20 bp, mouse
gaggagcccgcggagtgcct

SEQ ID NO: 839970 - DNA, 20 bp, mouse
gcgaccgagagtaaagggac

SEQ ID NO: 839971 - DNA, 20 bp, mouse
ggatccccaagcgtgggaat

SEQ ID NO: 839972 - DNA, 20 bp, mouse
ggggaggtcgcctctggaac

SEQ ID NO: 839973 - DNA, 20 bp, mouse
gcgtctccgaggcactccgc

SEQ ID NO: 839974 - DNA, 20 bp, mouse
gtggccacactggatgtaag

SEQ ID NO: 839975 - DNA, 20 bp, mouse
ggggaccggtatcgtctccg

SEQ ID NO: 839976 - DNA, 20 bp, mouse
gcccctagaaaaatacagta

SEQ ID NO: 839977 - DNA, 20 bp, mouse
gttgctgaggtccgcgtgaa

SEQ ID NO: 839978 - DNA, 20 bp, mouse
gctgaggtccgcgtgaaggg

SEQ ID NO: 839979 - DNA, 20 bp, mouse
ggccagaaacaatatagcga

SEQ ID NO: 839980 - DNA, 20 bp, mouse
gtgcctttccaacgtaagat

SEQ ID NO: 839981 - DNA, 20 bp, mouse
gttccaatcttacgttggaa

SEQ ID NO: 839982 - DNA, 20 bp, mouse
gatgaaaacagggatggtgc

SEQ ID NO: 839983 - DNA, 20 bp, mouse
gaatatagcgaaggagccaa

SEQ ID NO: 839984 - DNA, 20 bp, mouse
ggtcacttatgctgcaattt

SEQ ID NO: 839985 - DNA, 20 bp, mouse
ggccttactgtatttttcta

SEQ ID NO: 839986 - DNA, 20 bp, mouse
ggaactagagacaagggcca

SEQ ID NO: 839987 - DNA, 20 bp, mouse
gtgggagtccgaggcaaaaa

SEQ ID NO: 839988 - DNA, 20 bp, mouse
gtgtactgggagttgagatt

SEQ ID NO: 839989 - DNA, 20 bp, mouse
gtcaactcccagtacacaag

SEQ ID NO: 839990 - DNA, 20 bp, mouse
gggcccgctggaagagtgta

SEQ ID NO: 839991 - DNA, 20 bp, mouse
gtgcaaaggagaaacaccca

SEQ ID NO: 839992 - DNA, 20 bp, mouse
ggtagctagaactagagaca

SEQ ID NO: 839993 - DNA, 20 bp, mouse
gccagggcaccctgctaaaa

SEQ ID NO: 839994 - DNA, 20 bp, mouse
gtgggtgtttgaggctatac

SEQ ID NO: 839995 - DNA, 20 bp, mouse
gctctgaaaaccacgcccct

SEQ ID NO: 839996 - DNA, 20 bp, mouse
gcggactggcggggcgtccc

SEQ ID NO: 839997 - DNA, 20 bp, mouse
ggtcgcgctcccggaggtgg

SEQ ID NO: 839998 - DNA, 20 bp, mouse
gcgagacagcgcgagaagta

SEQ ID NO: 839999 - DNA, 20 bp, mouse
gtccgggagcgcgaccgcca

SEQ ID NO: 840000 - DNA, 20 bp, mouse
ggacgggcggcgtgccatgg

SEQ ID NO: 840001 - DNA, 20 bp, mouse
gagcggcggccatctcgctc

SEQ ID NO: 840002 - DNA, 20 bp, mouse
ggcgctgtctcgcacagcgg

SEQ ID NO: 840003 - DNA, 20 bp, mouse
gttaaggggcccaggcttca

SEQ ID NO: 840004 - DNA, 20 bp, mouse
ggaagttcgcagcgcccggg

SEQ ID NO: 840005 - DNA, 20 bp, mouse
ggagctcttccaccacctcc

SEQ ID NO: 840006 - DNA, 20 bp, mouse
ggggtggtggaagatcacca

SEQ ID NO: 840007 - DNA, 20 bp, mouse
ggggcctcgcaaggcatgca

SEQ ID NO: 840008 - DNA, 20 bp, mouse
gagggcggccatggggctag

SEQ ID NO: 840009 - DNA, 20 bp, mouse
gtggtggaagatcaccaggg

SEQ ID NO: 840010 - DNA, 20 bp, mouse
gatccgaggccccttctcta

SEQ ID NO: 840011 - DNA, 20 bp, mouse
gtgactaggccacgcagcag

SEQ ID NO: 840012 - DNA, 20 bp, mouse
ggccacgcagcagcgggaga

SEQ ID NO: 840013 - DNA, 20 bp, mouse
gcatgcagggaggtcactgc

SEQ ID NO: 840014 - DNA, 20 bp, mouse
gcgagggcttccatctgcac

SEQ ID NO: 840015 - DNA, 20 bp, mouse
gggaagccctcgccgcccgc

SEQ ID NO: 840016 - DNA, 20 bp, mouse
gccaccggagcaggcgagga

SEQ ID NO: 840017 - DNA, 20 bp, mouse
gccccgagggaggaccgcga

SEQ ID NO: 840018 - DNA, 20 bp, mouse
ggaggaccgcgagggcgact

SEQ ID NO: 840019 - DNA, 20 bp, mouse
gacgcggcgtgcagcacgag

SEQ ID NO: 840020 - DNA, 20 bp, mouse
ggccctcgcggtcctccctc

SEQ ID NO: 840021 - DNA, 20 bp, mouse
gaggagggggccaccggagc

SEQ ID NO: 840022 - DNA, 20 bp, mouse
gggcagcactcaatgctcag

SEQ ID NO: 840023 - DNA, 20 bp, mouse
gtgagtgctgccgagttgtg

SEQ ID NO: 840024 - DNA, 20 bp, mouse
gccagcctggaaacggcgcg

SEQ ID NO: 840025 - DNA, 20 bp, mouse
gggcgtggcccgatctccat

SEQ ID NO: 840026 - DNA, 20 bp, mouse
gcaaacccagtaagtggcaa

SEQ ID NO: 840027 - DNA, 20 bp, mouse
gtctgcccttgccacttact

SEQ ID NO: 840028 - DNA, 20 bp, mouse
gggctcacaaacccagtaag

SEQ ID NO: 840029 - DNA, 20 bp, mouse
gagccccgcacggcggtccg

SEQ ID NO: 840030 - DNA, 20 bp, mouse
ggtgccaaggtcacagaacc

SEQ ID NO: 840031 - DNA, 20 bp, mouse
gtggtgctttgccaaacggg

SEQ ID NO: 840032 - DNA, 20 bp, mouse
gggccggcctgggcaacccg

SEQ ID NO: 840033 - DNA, 20 bp, mouse
gggtacccagagccggccaa

SEQ ID NO: 840034 - DNA, 20 bp, mouse
gggcacctcttgcaagtggg

SEQ ID NO: 840035 - DNA, 20 bp, mouse
gcgaaagcggaaacacctac

SEQ ID NO: 840036 - DNA, 20 bp, mouse
gcaaaggagggctacatggg

SEQ ID NO: 840037 - DNA, 20 bp, mouse
gggtgggaattttagatcag

SEQ ID NO: 840038 - DNA, 20 bp, mouse
gacctctggcttccagggat

SEQ ID NO: 840039 - DNA, 20 bp, mouse
gatgggaggcttggtcagaa

SEQ ID NO: 840040 - DNA, 20 bp, mouse
gccttggaattttcttaaag

SEQ ID NO: 840041 - DNA, 20 bp, mouse
gtctcttctccactccctat

SEQ ID NO: 840042 - DNA, 20 bp, mouse
gctggagttttgttaagtac

SEQ ID NO: 840043 - DNA, 20 bp, mouse
ggtggtcatactatcaatat

SEQ ID NO: 840044 - DNA, 20 bp, mouse
gaggaattttaacatcaatt

SEQ ID NO: 840045 - DNA, 20 bp, mouse
gtatatataatactaataat

SEQ ID NO: 840046 - DNA, 20 bp, mouse
ggcagtaaggatgaacgcca

SEQ ID NO: 840047 - DNA, 20 bp, mouse
gggaagatcccgtggaagaa

SEQ ID NO: 840048 - DNA, 20 bp, mouse
gagaccactcagcagcagta

SEQ ID NO: 840049 - DNA, 20 bp, mouse
gtgaacgccagggtttgcct

SEQ ID NO: 840050 - DNA, 20 bp, mouse
gggccagccaaggcaaaccc

SEQ ID NO: 840051 - DNA, 20 bp, mouse
ggctccctgcatcaacctta

SEQ ID NO: 840052 - DNA, 20 bp, mouse
gggagacaatgcgttgccat

SEQ ID NO: 840053 - DNA, 20 bp, mouse
gaagatgaaggaagatcccg

SEQ ID NO: 840054 - DNA, 20 bp, mouse
gtacagggagattcaggaat

SEQ ID NO: 840055 - DNA, 20 bp, mouse
gcacaagagcacactcgctg

SEQ ID NO: 840056 - DNA, 20 bp, mouse
gttcccctgggcttgcatga

SEQ ID NO: 840057 - DNA, 20 bp, mouse
gaacacggagtggttaagtg

SEQ ID NO: 840058 - DNA, 20 bp, mouse
gacacctaagacgaggaggt

SEQ ID NO: 840059 - DNA, 20 bp, mouse
gccccagaaagaatcttctc

SEQ ID NO: 840060 - DNA, 20 bp, mouse
ggcccaggggaaaatgaaca

SEQ ID NO: 840061 - DNA, 20 bp, mouse
gcatccctcatgcaagccca

SEQ ID NO: 840062 - DNA, 20 bp, mouse
gaaacagcccgtggacaaaa

SEQ ID NO: 840063 - DNA, 20 bp, mouse
gtccgtgttcattttcccct

SEQ ID NO: 840064 - DNA, 20 bp, mouse
ggctcaggagaagatagccc

SEQ ID NO: 840065 - DNA, 20 bp, mouse
gttcctgagaagattctttc

SEQ ID NO: 840066 - DNA, 20 bp, mouse
gaactggaaggtgtgtccgc

SEQ ID NO: 840067 - DNA, 20 bp, mouse
gagggatggggcagccaagc

SEQ ID NO: 840068 - DNA, 20 bp, mouse
gctgtggtaacctatcttag

SEQ ID NO: 840069 - DNA, 20 bp, mouse
gtaccacagctgtcactcga

SEQ ID NO: 840070 - DNA, 20 bp, mouse
gtagggtcctccactaagat

SEQ ID NO: 840071 - DNA, 20 bp, mouse
gaggtgtgtccgcagggatg

SEQ ID NO: 840072 - DNA, 20 bp, mouse
gactcgaaggattacctggg

SEQ ID NO: 840073 - DNA, 20 bp, mouse
ggtcactcgaaggattacct

SEQ ID NO: 840074 - DNA, 20 bp, mouse
gaaggattacctgggaggaa

SEQ ID NO: 840075 - DNA, 20 bp, mouse
gtggtaacctatcttagtgg

SEQ ID NO: 840076 - DNA, 20 bp, mouse
ggtgcgcagcgtggcgacac

SEQ ID NO: 840077 - DNA, 20 bp, mouse
gcacgctgggcgggctcacc

SEQ ID NO: 840078 - DNA, 20 bp, mouse
ggcgcatgagcacgctgggc

SEQ ID NO: 840079 - DNA, 20 bp, mouse
gcggaggcctaacaccgcca

SEQ ID NO: 840080 - DNA, 20 bp, mouse
gaggctttccacgtggcaac

SEQ ID NO: 840081 - DNA, 20 bp, mouse
gcacaggcgcatgagcacgc

SEQ ID NO: 840082 - DNA, 20 bp, mouse
gggcctaacaccgccagggg

SEQ ID NO: 840083 - DNA, 20 bp, mouse
gtttccacgtggcaactgga

SEQ ID NO: 840084 - DNA, 20 bp, mouse
gaagcaaacagcgatcactc

SEQ ID NO: 840085 - DNA, 20 bp, mouse
gtggaggcaaaattccaagt

SEQ ID NO: 840086 - DNA, 20 bp, mouse
gtggggctgtgtctctactt

SEQ ID NO: 840087 - DNA, 20 bp, mouse
gagagtaggtgcttctctca

SEQ ID NO: 840088 - DNA, 20 bp, mouse
gaccacttccgttttgcctg

SEQ ID NO: 840089 - DNA, 20 bp, mouse
gaccccaggcaaaacggaag

SEQ ID NO: 840090 - DNA, 20 bp, mouse
ggaagcaaaggatagtttgg

SEQ ID NO: 840091 - DNA, 20 bp, mouse
gagacaatgtacgagacaag

SEQ ID NO: 840092 - DNA, 20 bp, mouse
gtagaagtactattacaact

SEQ ID NO: 840093 - DNA, 20 bp, mouse
gagcttaggacattggtttt

SEQ ID NO: 840094 - DNA, 20 bp, mouse
gatcctcagcacaaacaaca

SEQ ID NO: 840095 - DNA, 20 bp, mouse
gctcagaaggaccagcctcc

SEQ ID NO: 840096 - DNA, 20 bp, mouse
gaactcccggttactgcgac

SEQ ID NO: 840097 - DNA, 20 bp, mouse
gtcagccggtcgcagtaacc

SEQ ID NO: 840098 - DNA, 20 bp, mouse
gaaccgggagttgttgctag

SEQ ID NO: 840099 - DNA, 20 bp, mouse
gtggaacatgcgactacctg

SEQ ID NO: 840100 - DNA, 20 bp, mouse
gatgctctgcgttgctgtca

SEQ ID NO: 840101 - DNA, 20 bp, mouse
gctgagtagtggaaaagagt

SEQ ID NO: 840102 - DNA, 20 bp, mouse
ggaggagggtccaaagtcgc

SEQ ID NO: 840103 - DNA, 20 bp, mouse
gtgagattatacatgcatgg

SEQ ID NO: 840104 - DNA, 20 bp, mouse
gggcaaagttaagtccttgg

SEQ ID NO: 840105 - DNA, 20 bp, mouse
gagcctgcgctccgtctgtt

SEQ ID NO: 840106 - DNA, 20 bp, mouse
ggcactgcggaccacccgga

SEQ ID NO: 840107 - DNA, 20 bp, mouse
gcgagcgaacagctccggga

SEQ ID NO: 840108 - DNA, 20 bp, mouse
gcacccggagggcaccacgc

SEQ ID NO: 840109 - DNA, 20 bp, mouse
ggtggtccgcagtgcggcgg

SEQ ID NO: 840110 - DNA, 20 bp, mouse
gaacagcgagcgaacagctc

SEQ ID NO: 840111 - DNA, 20 bp, mouse
gagggcgccgacacaggcca

SEQ ID NO: 840112 - DNA, 20 bp, mouse
gtcgccgagtcactctactc

SEQ ID NO: 840113 - DNA, 20 bp, mouse
gatcctagctagataaggga

SEQ ID NO: 840114 - DNA, 20 bp, mouse
gggccccgcgtggtgccctc

SEQ ID NO: 840115 - DNA, 20 bp, mouse
gcgggtggtccgcagtgcgg

SEQ ID NO: 840116 - DNA, 20 bp, mouse
gtctctggcgggttcactgg

SEQ ID NO: 840117 - DNA, 20 bp, mouse
gtggaaacagaggggctcgg

SEQ ID NO: 840118 - DNA, 20 bp, mouse
ggccacgcccactcactaac

SEQ ID NO: 840119 - DNA, 20 bp, mouse
gagtgggcctgttagtgagt

SEQ ID NO: 840120 - DNA, 20 bp, mouse
gagtgggcgtggcctgcaag

SEQ ID NO: 840121 - DNA, 20 bp, mouse
gcgtggcctgcaagaggatc

SEQ ID NO: 840122 - DNA, 20 bp, mouse
ggactcttcaagtgaggggg

SEQ ID NO: 840123 - DNA, 20 bp, mouse
gcaagactcttcaagtgagg

SEQ ID NO: 840124 - DNA, 20 bp, mouse
gctccaagactcttcaagtg

SEQ ID NO: 840125 - DNA, 20 bp, mouse
gggctcggcgggccagatgg

SEQ ID NO: 840126 - DNA, 20 bp, mouse
gcaccgcgaccgcagcgagg

SEQ ID NO: 840127 - DNA, 20 bp, mouse
gcgcctgcgccaagcggcgg

SEQ ID NO: 840128 - DNA, 20 bp, mouse
gtcagctacccccgcagcgt

SEQ ID NO: 840129 - DNA, 20 bp, mouse
gagccccctcgctgcggtcg

SEQ ID NO: 840130 - DNA, 20 bp, mouse
gtcgccccctcagctcggtg

SEQ ID NO: 840131 - DNA, 20 bp, mouse
gggtggggacgggtgggcgt

SEQ ID NO: 840132 - DNA, 20 bp, mouse
gcccctcagctcggtggggt

SEQ ID NO: 840133 - DNA, 20 bp, mouse
gggacagggcccatcatgag

SEQ ID NO: 840134 - DNA, 20 bp, mouse
gcgcgcgcgaacatccgcag

SEQ ID NO: 840135 - DNA, 20 bp, mouse
gtcggtgctcgcaggactca

SEQ ID NO: 840136 - DNA, 20 bp, mouse
gttgggacagaagtcggaga

SEQ ID NO: 840137 - DNA, 20 bp, mouse
gttgcatgccgggagaaacc

SEQ ID NO: 840138 - DNA, 20 bp, mouse
gggtccctggaggttttttg

SEQ ID NO: 840139 - DNA, 20 bp, mouse
gaaaccgggagtataatgtc

SEQ ID NO: 840140 - DNA, 20 bp, mouse
gtcaacggttcctagtcatg

SEQ ID NO: 840141 - DNA, 20 bp, mouse
ggggaccccaggccctaatc

SEQ ID NO: 840142 - DNA, 20 bp, mouse
gagtccagacattatactcc

SEQ ID NO: 840143 - DNA, 20 bp, mouse
gcaaagtggatacgtcccat

SEQ ID NO: 840144 - DNA, 20 bp, mouse
ggtactgaaatctggggact

SEQ ID NO: 840145 - DNA, 20 bp, mouse
gactcgttctaacgagtaaa

SEQ ID NO: 840146 - DNA, 20 bp, mouse
gtaggtagagaaatagtagc

SEQ ID NO: 840147 - DNA, 20 bp, mouse
gggcaacaagccaacggaaa

SEQ ID NO: 840148 - DNA, 20 bp, mouse
gagggaagtgtgatttggaa

SEQ ID NO: 840149 - DNA, 20 bp, mouse
ggtatctagccattcttgga

SEQ ID NO: 840150 - DNA, 20 bp, mouse
gcacatacagtcatcccttt

SEQ ID NO: 840151 - DNA, 20 bp, mouse
gtccagacttccgtttccgt

SEQ ID NO: 840152 - DNA, 20 bp, mouse
gctcttagaaaccaacttcc

SEQ ID NO: 840153 - DNA, 20 bp, mouse
gagaagtatctagccattct

SEQ ID NO: 840154 - DNA, 20 bp, mouse
gtccgttggcttgttgccat

SEQ ID NO: 840155 - DNA, 20 bp, mouse
gttcttccagaaacggggaa

SEQ ID NO: 840156 - DNA, 20 bp, mouse
gagactgtggggaagcaatt

SEQ ID NO: 840157 - DNA, 20 bp, mouse
ggaagcaattgggcttggtc

SEQ ID NO: 840158 - DNA, 20 bp, mouse
gccaggatgcagggcgataa

SEQ ID NO: 840159 - DNA, 20 bp, mouse
gaacggaagcgatgtaggcc

SEQ ID NO: 840160 - DNA, 20 bp, mouse
ggcgataacggaagcgatgt

SEQ ID NO: 840161 - DNA, 20 bp, mouse
gtttctaggtagttcagaga

SEQ ID NO: 840162 - DNA, 20 bp, mouse
ggcaataggccaaccggaaa

SEQ ID NO: 840163 - DNA, 20 bp, mouse
gaacagcttccgtttccggt

SEQ ID NO: 840164 - DNA, 20 bp, mouse
gagcgatgtaggccgggacg

SEQ ID NO: 840165 - DNA, 20 bp, mouse
gggtgacgaaatgggaatga

SEQ ID NO: 840166 - DNA, 20 bp, mouse
gagcgcctgacgccgttcgc

SEQ ID NO: 840167 - DNA, 20 bp, mouse
gtggtggtgcgcatatatcc

SEQ ID NO: 840168 - DNA, 20 bp, mouse
gagtgcccatggccgggcgg

SEQ ID NO: 840169 - DNA, 20 bp, mouse
ggccaacgaagtcccgtgag

SEQ ID NO: 840170 - DNA, 20 bp, mouse
gatactacgggtcttcaaac

SEQ ID NO: 840171 - DNA, 20 bp, mouse
gacgggacttcgttggctaa

SEQ ID NO: 840172 - DNA, 20 bp, mouse
gcgtagtatcgcgagacaac

SEQ ID NO: 840173 - DNA, 20 bp, mouse
ggacagacagtgcccatggc

SEQ ID NO: 840174 - DNA, 20 bp, mouse
ggacagtgcccatggccggg

SEQ ID NO: 840175 - DNA, 20 bp, mouse
gagctctagacgcttatttt

SEQ ID NO: 840176 - DNA, 20 bp, mouse
ggggcgccgcagtgacttct

SEQ ID NO: 840177 - DNA, 20 bp, mouse
gctggactttagaacgtccc

SEQ ID NO: 840178 - DNA, 20 bp, mouse
gaagtcactgcggcgcccta

SEQ ID NO: 840179 - DNA, 20 bp, mouse
ggcggcgccctagggactat

SEQ ID NO: 840180 - DNA, 20 bp, mouse
ggaccggcctagccgctgaa

SEQ ID NO: 840181 - DNA, 20 bp, mouse
ggggccagaccacctgccaa

SEQ ID NO: 840182 - DNA, 20 bp, mouse
gcggctaggccggtcagact

SEQ ID NO: 840183 - DNA, 20 bp, mouse
gaaacacgggagtccattcc

SEQ ID NO: 840184 - DNA, 20 bp, mouse
gacaaatcccatagtcccta

SEQ ID NO: 840185 - DNA, 20 bp, mouse
ggcgccctctaactgcagcc

SEQ ID NO: 840186 - DNA, 20 bp, mouse
gctcccccggacgcctggga

SEQ ID NO: 840187 - DNA, 20 bp, mouse
gctgctggccggggacgtgg

SEQ ID NO: 840188 - DNA, 20 bp, mouse
gcggacgcctgggacggagg

SEQ ID NO: 840189 - DNA, 20 bp, mouse
gtgagcgcctcctccgtccc

SEQ ID NO: 840190 - DNA, 20 bp, mouse
gctggccggggacgtggcgg

SEQ ID NO: 840191 - DNA, 20 bp, mouse
gagcgcgcgggggaccgcac

SEQ ID NO: 840192 - DNA, 20 bp, mouse
gagcagcggcgcgtgctctc

SEQ ID NO: 840193 - DNA, 20 bp, mouse
ggcccagcgctggtcgccgt

SEQ ID NO: 840194 - DNA, 20 bp, mouse
gcagcagcaggcactcggcc

SEQ ID NO: 840195 - DNA, 20 bp, mouse
gtcgcgtggcacctgcccga

SEQ ID NO: 840196 - DNA, 20 bp, mouse
gcctgccaggtcagtaaccc

SEQ ID NO: 840197 - DNA, 20 bp, mouse
gtgaaggtcactccagacaa

SEQ ID NO: 840198 - DNA, 20 bp, mouse
gtcagtaaccctggccactg

SEQ ID NO: 840199 - DNA, 20 bp, mouse
ggtcactccagacaagggac

SEQ ID NO: 840200 - DNA, 20 bp, mouse
gcacacctctgtacctgagg

SEQ ID NO: 840201 - DNA, 20 bp, mouse
ggtggccagggttactgacc

SEQ ID NO: 840202 - DNA, 20 bp, mouse
gtgagcactgaagtatatcc

SEQ ID NO: 840203 - DNA, 20 bp, mouse
gccaggacctcagaggttct

SEQ ID NO: 840204 - DNA, 20 bp, mouse
gctgaggctggactaaggat

SEQ ID NO: 840205 - DNA, 20 bp, mouse
gactgaaaaaccaccctgcc

SEQ ID NO: 840206 - DNA, 20 bp, mouse
ggagcaggggccggactcta

SEQ ID NO: 840207 - DNA, 20 bp, mouse
ggggcatggccgttcagaag

SEQ ID NO: 840208 - DNA, 20 bp, mouse
gctgcccttggcctgatggg

SEQ ID NO: 840209 - DNA, 20 bp, mouse
gacacctcccatcaggccaa

SEQ ID NO: 840210 - DNA, 20 bp, mouse
gagggacaagactagaagtt

SEQ ID NO: 840211 - DNA, 20 bp, mouse
gagaaactacacctcccatc

SEQ ID NO: 840212 - DNA, 20 bp, mouse
gtccggcccctgctcatgac

SEQ ID NO: 840213 - DNA, 20 bp, mouse
gccaacagcaacagcatcgc

SEQ ID NO: 840214 - DNA, 20 bp, mouse
ggctctccagtcatgagcag

SEQ ID NO: 840215 - DNA, 20 bp, mouse
gctcactcaagcgatgtctg

SEQ ID NO: 840216 - DNA, 20 bp, mouse
gcacatgcgcagctcatctc

SEQ ID NO: 840217 - DNA, 20 bp, mouse
gcgacccacaggttccctgg

SEQ ID NO: 840218 - DNA, 20 bp, mouse
ggttccctggtggatgtggg

SEQ ID NO: 840219 - DNA, 20 bp, mouse
ggcggagcggggcgaagcga

SEQ ID NO: 840220 - DNA, 20 bp, mouse
gacacctcccacatccacca

SEQ ID NO: 840221 - DNA, 20 bp, mouse
gcctccctctggcccagtga

SEQ ID NO: 840222 - DNA, 20 bp, mouse
gtggcccagtgaaggagact

SEQ ID NO: 840223 - DNA, 20 bp, mouse
ggagcggggcgaagcgaggg

SEQ ID NO: 840224 - DNA, 20 bp, mouse
ggggtgggggtaaagagaat

SEQ ID NO: 840225 - DNA, 20 bp, mouse
gcggtcgcatttcccaggtg

SEQ ID NO: 840226 - DNA, 20 bp, mouse
gcacccgcgcagtgggacca

SEQ ID NO: 840227 - DNA, 20 bp, mouse
gggacccgggcgctcaaggt

SEQ ID NO: 840228 - DNA, 20 bp, mouse
gcccgagtgggtggaggtgt

SEQ ID NO: 840229 - DNA, 20 bp, mouse
gagctgaggcctagggaagg

SEQ ID NO: 840230 - DNA, 20 bp, mouse
ggggagctgaggcctaggga

SEQ ID NO: 840231 - DNA, 20 bp, mouse
gacggggccgggccggtctc

SEQ ID NO: 840232 - DNA, 20 bp, mouse
gcccacctggccagcgccag

SEQ ID NO: 840233 - DNA, 20 bp, mouse
ggggctgcccacccgcgcag

SEQ ID NO: 840234 - DNA, 20 bp, mouse
gcagcctggccttggagcat

SEQ ID NO: 840235 - DNA, 20 bp, mouse
gcagcgcccgcccctggcgc

SEQ ID NO: 840236 - DNA, 20 bp, mouse
gggctcctgccaatcctcta

SEQ ID NO: 840237 - DNA, 20 bp, mouse
gtgcgcacccagtaccccag

SEQ ID NO: 840238 - DNA, 20 bp, mouse
gtcagcgggtgctcgggaaa

SEQ ID NO: 840239 - DNA, 20 bp, mouse
gcagccaaccaggttccgtg

SEQ ID NO: 840240 - DNA, 20 bp, mouse
ggactcctccccacggaacc

SEQ ID NO: 840241 - DNA, 20 bp, mouse
gggagcgcagccacgacctt

SEQ ID NO: 840242 - DNA, 20 bp, mouse
gtcgccggatagccccgccc

SEQ ID NO: 840243 - DNA, 20 bp, mouse
gagggaggccagtaccccag

SEQ ID NO: 840244 - DNA, 20 bp, mouse
gcgagcacccgctgactctg

SEQ ID NO: 840245 - DNA, 20 bp, mouse
gctcgggaaaaggacctctg

SEQ ID NO: 840246 - DNA, 20 bp, mouse
ggggacgcctggatcgaagc

SEQ ID NO: 840247 - DNA, 20 bp, mouse
gacacccgaaacggctgggg

SEQ ID NO: 840248 - DNA, 20 bp, mouse
gaaccctggacgcactggga

SEQ ID NO: 840249 - DNA, 20 bp, mouse
gcgggcgcagacacccgaaa

SEQ ID NO: 840250 - DNA, 20 bp, mouse
ggggcaggagagcttaactc

SEQ ID NO: 840251 - DNA, 20 bp, mouse
gcagacacccgaaacggctg

SEQ ID NO: 840252 - DNA, 20 bp, mouse
ggcccctcccagtgcgtcca

SEQ ID NO: 840253 - DNA, 20 bp, mouse
gcaggaagcggaggtagctc

SEQ ID NO: 840254 - DNA, 20 bp, mouse
ggcctctggggccggttccg

SEQ ID NO: 840255 - DNA, 20 bp, mouse
ggaggggctgcaggaagcgg

SEQ ID NO: 840256 - DNA, 20 bp, mouse
ggtcgcgcttatataggcgg

SEQ ID NO: 840257 - DNA, 20 bp, mouse
gcaatcccggcggcactaca

SEQ ID NO: 840258 - DNA, 20 bp, mouse
gagcgcgagtagcacggaag

SEQ ID NO: 840259 - DNA, 20 bp, mouse
gggagtcgcgcttatatagg

SEQ ID NO: 840260 - DNA, 20 bp, mouse
gactctgcgagcggagcgga

SEQ ID NO: 840261 - DNA, 20 bp, mouse
gcggcggcactacaaggaag

SEQ ID NO: 840262 - DNA, 20 bp, mouse
ggggcagcaccgtcctcccc

SEQ ID NO: 840263 - DNA, 20 bp, mouse
gggcggaaacagcctagagg

SEQ ID NO: 840264 - DNA, 20 bp, mouse
gtaagcggccagggccccag

SEQ ID NO: 840265 - DNA, 20 bp, mouse
gtgcgcggcacaaagaagct

SEQ ID NO: 840266 - DNA, 20 bp, mouse
gggccaggcaaactctgcaa

SEQ ID NO: 840267 - DNA, 20 bp, mouse
gactctgcaatggatgggtg

SEQ ID NO: 840268 - DNA, 20 bp, mouse
gcccaaagcgaggagactag

SEQ ID NO: 840269 - DNA, 20 bp, mouse
ggcaatggatgggtggggct

SEQ ID NO: 840270 - DNA, 20 bp, mouse
gcaggccggcggaacccgag

SEQ ID NO: 840271 - DNA, 20 bp, mouse
gaacgcgccgctccttccgg

SEQ ID NO: 840272 - DNA, 20 bp, mouse
gcgtggcctgcctggaggtg

SEQ ID NO: 840273 - DNA, 20 bp, mouse
gggcaaactctgcaatggat

SEQ ID NO: 840274 - DNA, 20 bp, mouse
gtatgcctctcgggttccgc

SEQ ID NO: 840275 - DNA, 20 bp, mouse
gtcaggccacacctccaggc

SEQ ID NO: 840276 - DNA, 20 bp, mouse
ggcgacccctggggctccgg

SEQ ID NO: 840277 - DNA, 20 bp, mouse
ggaaaccacagcgacccctg

SEQ ID NO: 840278 - DNA, 20 bp, mouse
ggccaatctgatctacttgg

SEQ ID NO: 840279 - DNA, 20 bp, mouse
gtgggcctccggagccccag

SEQ ID NO: 840280 - DNA, 20 bp, mouse
gtctgtggttgaaaagttgg

SEQ ID NO: 840281 - DNA, 20 bp, mouse
ggtcgctgtggtttcagcgt

SEQ ID NO: 840282 - DNA, 20 bp, mouse
gggagccccaggggtcgctg

SEQ ID NO: 840283 - DNA, 20 bp, mouse
gaggcatggctgagtctctg

SEQ ID NO: 840284 - DNA, 20 bp, mouse
ggtggccaatctgatctact

SEQ ID NO: 840285 - DNA, 20 bp, mouse
gccaagttctggattaagtt

SEQ ID NO: 840286 - DNA, 20 bp, mouse
gtatgaccaggtttcctctt

SEQ ID NO: 840287 - DNA, 20 bp, mouse
gagggcctggaactgatttc

SEQ ID NO: 840288 - DNA, 20 bp, mouse
gggtggaaacgggtcccaag

SEQ ID NO: 840289 - DNA, 20 bp, mouse
gaggcaatccactgtgacag

SEQ ID NO: 840290 - DNA, 20 bp, mouse
gaactgagacctctcatgaa

SEQ ID NO: 840291 - DNA, 20 bp, mouse
gatgagaggtctcagttcaa

SEQ ID NO: 840292 - DNA, 20 bp, mouse
gttcaatggatggtggaaac

SEQ ID NO: 840293 - DNA, 20 bp, mouse
gagcttaaacccttcatgag

SEQ ID NO: 840294 - DNA, 20 bp, mouse
gatccactgtgacaggggtt

SEQ ID NO: 840295 - DNA, 20 bp, mouse
ggaggtctcagttcaatgga

SEQ ID NO: 840296 - DNA, 20 bp, mouse
gagtcctgacgggatgggga

SEQ ID NO: 840297 - DNA, 20 bp, mouse
gccaagagtcctgacgggat

SEQ ID NO: 840298 - DNA, 20 bp, mouse
ggtcggctcgcctagcccgg

SEQ ID NO: 840299 - DNA, 20 bp, mouse
gtgtgcgcgcttggcttctg

SEQ ID NO: 840300 - DNA, 20 bp, mouse
gcccaggccaagagtcctga

SEQ ID NO: 840301 - DNA, 20 bp, mouse
gggctcgcctagcccggcgg

SEQ ID NO: 840302 - DNA, 20 bp, mouse
ggcccgggcgtctccaacag

SEQ ID NO: 840303 - DNA, 20 bp, mouse
gggtccgggcggaggacccc

SEQ ID NO: 840304 - DNA, 20 bp, mouse
gccgcggctccaccccaaag

SEQ ID NO: 840305 - DNA, 20 bp, mouse
gagcctctggactggggctg

SEQ ID NO: 840306 - DNA, 20 bp, mouse
gcggaggccggacagcaatg

SEQ ID NO: 840307 - DNA, 20 bp, mouse
ggcggtgaggggtcaagcca

SEQ ID NO: 840308 - DNA, 20 bp, mouse
ggagccccagagcatcctcg

SEQ ID NO: 840309 - DNA, 20 bp, mouse
gagcgaacctggagcggtga

SEQ ID NO: 840310 - DNA, 20 bp, mouse
gctcaggagcgaacctggag

SEQ ID NO: 840311 - DNA, 20 bp, mouse
gtagtgcgagagggcgtgaa

SEQ ID NO: 840312 - DNA, 20 bp, mouse
gggacagcaatgaggagcgc

SEQ ID NO: 840313 - DNA, 20 bp, mouse
gcggtgctcaggagcgaacc

SEQ ID NO: 840314 - DNA, 20 bp, mouse
gggaacgccggccggggaag

SEQ ID NO: 840315 - DNA, 20 bp, mouse
ggagccgcagcgggccgggg

SEQ ID NO: 840316 - DNA, 20 bp, mouse
ggcagcgcgcctgaaaacag

SEQ ID NO: 840317 - DNA, 20 bp, mouse
ggcgcctgaaaacaggggac

SEQ ID NO: 840318 - DNA, 20 bp, mouse
ggcacggaggaccctgtccg

SEQ ID NO: 840319 - DNA, 20 bp, mouse
gcaattctttgcaaactctc

SEQ ID NO: 840320 - DNA, 20 bp, mouse
gaagtggggcgtagtgagac

SEQ ID NO: 840321 - DNA, 20 bp, mouse
gtacagggtaagcaaccgga

SEQ ID NO: 840322 - DNA, 20 bp, mouse
gcggcggggcctggctaagg

SEQ ID NO: 840323 - DNA, 20 bp, mouse
gggcagtgttcaaattgcaa

SEQ ID NO: 840324 - DNA, 20 bp, mouse
gagtaggaatgcgcgaagtg

SEQ ID NO: 840325 - DNA, 20 bp, mouse
gagacggaaaaatactgtag

SEQ ID NO: 840326 - DNA, 20 bp, mouse
gacaacgggcccgactgggg

SEQ ID NO: 840327 - DNA, 20 bp, mouse
gagcccgcggggacaggttg

SEQ ID NO: 840328 - DNA, 20 bp, mouse
ggggacaacgggcccgactg

SEQ ID NO: 840329 - DNA, 20 bp, mouse
gcctcggaaggctggatgaa

SEQ ID NO: 840330 - DNA, 20 bp, mouse
gtgtcccctgcaccacggcc

SEQ ID NO: 840331 - DNA, 20 bp, mouse
gaaaagggcggggacgaggg

SEQ ID NO: 840332 - DNA, 20 bp, mouse
gcagaaaagggcggggacga

SEQ ID NO: 840333 - DNA, 20 bp, mouse
gccacggccaggctcgcaca

SEQ ID NO: 840334 - DNA, 20 bp, mouse
gtccggtagcccgcggggac

SEQ ID NO: 840335 - DNA, 20 bp, mouse
gtggatgaatgggaaccagg

SEQ ID NO: 840336 - DNA, 20 bp, mouse
ggtctccggctgccccctat

SEQ ID NO: 840337 - DNA, 20 bp, mouse
gtgggagggtaaggactgtg

SEQ ID NO: 840338 - DNA, 20 bp, mouse
gcgccagaacaactagaccc

SEQ ID NO: 840339 - DNA, 20 bp, mouse
gggagaacatgcagtcgggt

SEQ ID NO: 840340 - DNA, 20 bp, mouse
gaacatgcagtcgggtggga

SEQ ID NO: 840341 - DNA, 20 bp, mouse
gctggtttgagggtgagcga

SEQ ID NO: 840342 - DNA, 20 bp, mouse
gcatctctggctgccgtctc

SEQ ID NO: 840343 - DNA, 20 bp, mouse
gagaacaactagacccaggc

SEQ ID NO: 840344 - DNA, 20 bp, mouse
gctccgggagaacatgcagt

SEQ ID NO: 840345 - DNA, 20 bp, mouse
gcgggcagacatcagttttg

SEQ ID NO: 840346 - DNA, 20 bp, mouse
gcctccccagcggaccaacc

SEQ ID NO: 840347 - DNA, 20 bp, mouse
gcaagctggccaacgagaga

SEQ ID NO: 840348 - DNA, 20 bp, mouse
gaaaaaaagccgcacgatat

SEQ ID NO: 840349 - DNA, 20 bp, mouse
gtcccggccacttctccaat

SEQ ID NO: 840350 - DNA, 20 bp, mouse
gtagaggctaaactgctggc

SEQ ID NO: 840351 - DNA, 20 bp, mouse
gaatgcgcgtgccccgttag

SEQ ID NO: 840352 - DNA, 20 bp, mouse
ggcctcttgtgcctcacttg

SEQ ID NO: 840353 - DNA, 20 bp, mouse
gccggagtcccgcccatctc

SEQ ID NO: 840354 - DNA, 20 bp, mouse
gctggccaacgagagaagga

SEQ ID NO: 840355 - DNA, 20 bp, mouse
gaaaagccgcacgatatcgg

SEQ ID NO: 840356 - DNA, 20 bp, mouse
gtggtcgtgacgctacgtat

SEQ ID NO: 840357 - DNA, 20 bp, mouse
gatgcgtagttgtctatcta

SEQ ID NO: 840358 - DNA, 20 bp, mouse
gggctgccatagtaacatgg

SEQ ID NO: 840359 - DNA, 20 bp, mouse
gtggagggctgggatttgcc

SEQ ID NO: 840360 - DNA, 20 bp, mouse
gctgggttgcttaattagaa

SEQ ID NO: 840361 - DNA, 20 bp, mouse
gagtaacatggaggcgcgca

SEQ ID NO: 840362 - DNA, 20 bp, mouse
gttccggccagctgcgcatc

SEQ ID NO: 840363 - DNA, 20 bp, mouse
gtccggctgccatagtaaca

SEQ ID NO: 840364 - DNA, 20 bp, mouse
gcatggaggcgcgcaaggat

SEQ ID NO: 840365 - DNA, 20 bp, mouse
ggatctgccttgcctctact

SEQ ID NO: 840366 - DNA, 20 bp, mouse
gaggacgccggcatgctccc

SEQ ID NO: 840367 - DNA, 20 bp, mouse
gagcatgccggcgtcctcac

SEQ ID NO: 840368 - DNA, 20 bp, mouse
gtgagctccagtgaggacgc

SEQ ID NO: 840369 - DNA, 20 bp, mouse
gtcagagcgcgccaagcctg

SEQ ID NO: 840370 - DNA, 20 bp, mouse
ggcctgagggagactgtaat

SEQ ID NO: 840371 - DNA, 20 bp, mouse
gagcggctctggctccctct

SEQ ID NO: 840372 - DNA, 20 bp, mouse
gccgagcaggcaagcggctc

SEQ ID NO: 840373 - DNA, 20 bp, mouse
gtggctccctctgggtctag

SEQ ID NO: 840374 - DNA, 20 bp, mouse
gtgagcttgggagactccag

SEQ ID NO: 840375 - DNA, 20 bp, mouse
ggactctcccgcttgattgg

SEQ ID NO: 840376 - DNA, 20 bp, mouse
gacagctcggggtaccaggt

SEQ ID NO: 840377 - DNA, 20 bp, mouse
gcctaaggatcgttttcctc

SEQ ID NO: 840378 - DNA, 20 bp, mouse
ggggaaaaagggttccggtg

SEQ ID NO: 840379 - DNA, 20 bp, mouse
ggaaaacgatccttaggagg

SEQ ID NO: 840380 - DNA, 20 bp, mouse
gggcggcggggtgagaggtc

SEQ ID NO: 840381 - DNA, 20 bp, mouse
gaggccgagggaacaaatcc

SEQ ID NO: 840382 - DNA, 20 bp, mouse
ggccacagccgggcgccgag

SEQ ID NO: 840383 - DNA, 20 bp, mouse
ggcctggccggctagaagtc

SEQ ID NO: 840384 - DNA, 20 bp, mouse
gccggcgcagtgagcctcac

SEQ ID NO: 840385 - DNA, 20 bp, mouse
gcgccgagaggcttcggagc

SEQ ID NO: 840386 - DNA, 20 bp, mouse
gacaaacagtccgtcagaga

SEQ ID NO: 840387 - DNA, 20 bp, mouse
gtagcctagcagatgaaatc

SEQ ID NO: 840388 - DNA, 20 bp, mouse
gtggaagagcgcttggtttc

SEQ ID NO: 840389 - DNA, 20 bp, mouse
gacagtccgtcagagaagga

SEQ ID NO: 840390 - DNA, 20 bp, mouse
ggtcgtaaaaagaagcgttg

SEQ ID NO: 840391 - DNA, 20 bp, mouse
gctgaaccgtgacaccaaaa

SEQ ID NO: 840392 - DNA, 20 bp, mouse
gaggattactggttaggtag

SEQ ID NO: 840393 - DNA, 20 bp, mouse
gcggaatacagctaccgtac

SEQ ID NO: 840394 - DNA, 20 bp, mouse
gtcgtaacaaggtttatggg

SEQ ID NO: 840395 - DNA, 20 bp, mouse
gacggctacaatgctctcca

SEQ ID NO: 840396 - DNA, 20 bp, mouse
gtccccgggccgcttgaagt

SEQ ID NO: 840397 - DNA, 20 bp, mouse
gtggaagcgtgggccgtgat

SEQ ID NO: 840398 - DNA, 20 bp, mouse
gcggacccacccacttcaag

SEQ ID NO: 840399 - DNA, 20 bp, mouse
gaggatgtcccgacagggag

SEQ ID NO: 840400 - DNA, 20 bp, mouse
gggtccggcctcaacgcagg

SEQ ID NO: 840401 - DNA, 20 bp, mouse
gggaccttgcactaccctcc

SEQ ID NO: 840402 - DNA, 20 bp, mouse
ggcagctgcgggtaactccc

SEQ ID NO: 840403 - DNA, 20 bp, mouse
gggcctcaacgcaggagggg

SEQ ID NO: 840404 - DNA, 20 bp, mouse
gctccctggagggtagtgca

SEQ ID NO: 840405 - DNA, 20 bp, mouse
gcgagcgcgtcggcagctgc

SEQ ID NO: 840406 - DNA, 20 bp, mouse
gagtgtgtggccggtgacat

SEQ ID NO: 840407 - DNA, 20 bp, mouse
gcgccccgccactcagtgtg

SEQ ID NO: 840408 - DNA, 20 bp, mouse
ggccctggtgggccctgctt

SEQ ID NO: 840409 - DNA, 20 bp, mouse
gtcccaagcagggcccacca

SEQ ID NO: 840410 - DNA, 20 bp, mouse
gccgccactcagtgtgtggc

SEQ ID NO: 840411 - DNA, 20 bp, mouse
gtccgcgcggcgctaagggc

SEQ ID NO: 840412 - DNA, 20 bp, mouse
gggaagacccagacagaggg

SEQ ID NO: 840413 - DNA, 20 bp, mouse
gggtggaagacccagacaga

SEQ ID NO: 840414 - DNA, 20 bp, mouse
gcggaatcacggtcgtgggc

SEQ ID NO: 840415 - DNA, 20 bp, mouse
gcggcaggagctcccaagca

SEQ ID NO: 840416 - DNA, 20 bp, mouse
ggagtcgaactgagctgata

SEQ ID NO: 840417 - DNA, 20 bp, mouse
ggctcactccacttccggag

SEQ ID NO: 840418 - DNA, 20 bp, mouse
gccagcggttttcgcgttct

SEQ ID NO: 840419 - DNA, 20 bp, mouse
gaaagaaggtgtcacaacca

SEQ ID NO: 840420 - DNA, 20 bp, mouse
gcatcacatatgtaggtccc

SEQ ID NO: 840421 - DNA, 20 bp, mouse
gtggttgcagtagagaggac

SEQ ID NO: 840422 - DNA, 20 bp, mouse
gggttgctaggacacctctc

SEQ ID NO: 840423 - DNA, 20 bp, mouse
ggacctacatatgtgatgga

SEQ ID NO: 840424 - DNA, 20 bp, mouse
gcaggaagcagtagcgccag

SEQ ID NO: 840425 - DNA, 20 bp, mouse
gaactcgcagaaaaataccg

SEQ ID NO: 840426 - DNA, 20 bp, mouse
gagggcccgctgtgatggta

SEQ ID NO: 840427 - DNA, 20 bp, mouse
gtagtgagggcccgctgtga

SEQ ID NO: 840428 - DNA, 20 bp, mouse
gaacaaaggtccacatacta

SEQ ID NO: 840429 - DNA, 20 bp, mouse
gagctgacacgggttcgagg

SEQ ID NO: 840430 - DNA, 20 bp, mouse
gcctggaggccctgacttga

SEQ ID NO: 840431 - DNA, 20 bp, mouse
gaacttgcacgaaatggggt

SEQ ID NO: 840432 - DNA, 20 bp, mouse
gccagggcgaggaacccttg

SEQ ID NO: 840433 - DNA, 20 bp, mouse
ggagaaacttgcacgaaatg

SEQ ID NO: 840434 - DNA, 20 bp, mouse
gccgctgtgatggtacggac

SEQ ID NO: 840435 - DNA, 20 bp, mouse
gtacacatgccctcaagtca

SEQ ID NO: 840436 - DNA, 20 bp, mouse
gctgtcagcagtggtggata

SEQ ID NO: 840437 - DNA, 20 bp, mouse
ggtaggtggggtgtaaatca

SEQ ID NO: 840438 - DNA, 20 bp, mouse
gtcctggctgagggaaagtt

SEQ ID NO: 840439 - DNA, 20 bp, mouse
gacagtgctgcctcgatact

SEQ ID NO: 840440 - DNA, 20 bp, mouse
ggtgtctagaacccagtagg

SEQ ID NO: 840441 - DNA, 20 bp, mouse
gagcccgtcaggaacctgtt

SEQ ID NO: 840442 - DNA, 20 bp, mouse
gtgtccctcggggctctgat

SEQ ID NO: 840443 - DNA, 20 bp, mouse
gggcacaggtcgacaactcg

SEQ ID NO: 840444 - DNA, 20 bp, mouse
ggggaaggacagtgtggcct

SEQ ID NO: 840445 - DNA, 20 bp, mouse
gaccactgctgacaggtata

SEQ ID NO: 840446 - DNA, 20 bp, mouse
gtcgggacggggccccgcaa

SEQ ID NO: 840447 - DNA, 20 bp, mouse
gccaagctcgggagcgagac

SEQ ID NO: 840448 - DNA, 20 bp, mouse
ggccacctctgtgacaggcc

SEQ ID NO: 840449 - DNA, 20 bp, mouse
gagtctgaggctcacagaaa

SEQ ID NO: 840450 - DNA, 20 bp, mouse
gtcgctcccgagcttggaaa

SEQ ID NO: 840451 - DNA, 20 bp, mouse
ggcggggccccgtcccgagg

SEQ ID NO: 840452 - DNA, 20 bp, mouse
gcgagcgcgtccacgtgacc

SEQ ID NO: 840453 - DNA, 20 bp, mouse
gaccaggcctgtcacagagg

SEQ ID NO: 840454 - DNA, 20 bp, mouse
ggagcactcagggactggct

SEQ ID NO: 840455 - DNA, 20 bp, mouse
ggatgaatgtagtaggactg

SEQ ID NO: 840456 - DNA, 20 bp, mouse
gcatcccaggactgccgcga

SEQ ID NO: 840457 - DNA, 20 bp, mouse
gagccggtgaagctgagatg

SEQ ID NO: 840458 - DNA, 20 bp, mouse
ggactgccgcgagggattct

SEQ ID NO: 840459 - DNA, 20 bp, mouse
gtcaggagagattgtcctca

SEQ ID NO: 840460 - DNA, 20 bp, mouse
gaaggtgctcccccttgcgc

SEQ ID NO: 840461 - DNA, 20 bp, mouse
ggcgcacgcgcctgcgtcct

SEQ ID NO: 840462 - DNA, 20 bp, mouse
gcagcttcaccggctccttg

SEQ ID NO: 840463 - DNA, 20 bp, mouse
gtgtcttctccattcatccc

SEQ ID NO: 840464 - DNA, 20 bp, mouse
ggcgttcccagaatccctcg

SEQ ID NO: 840465 - DNA, 20 bp, mouse
gaaggttaggagactgcgtc

SEQ ID NO: 840466 - DNA, 20 bp, mouse
gccccctcggggttaactcc

SEQ ID NO: 840467 - DNA, 20 bp, mouse
gaggtccgagtgtacgtgaa

SEQ ID NO: 840468 - DNA, 20 bp, mouse
ggtggaacccgccccaatat

SEQ ID NO: 840469 - DNA, 20 bp, mouse
ggaacccgccccaatatggg

SEQ ID NO: 840470 - DNA, 20 bp, mouse
gccggcaaatgcagacagct

SEQ ID NO: 840471 - DNA, 20 bp, mouse
gccaaagtgggtgtggttcc

SEQ ID NO: 840472 - DNA, 20 bp, mouse
ggacagctagggggccaaga

SEQ ID NO: 840473 - DNA, 20 bp, mouse
gaacgctactgcaatagggg

SEQ ID NO: 840474 - DNA, 20 bp, mouse
gagccaggagttaaccccga

SEQ ID NO: 840475 - DNA, 20 bp, mouse
ggccgtcgctatggacacga

SEQ ID NO: 840476 - DNA, 20 bp, mouse
gtgttagcctgtatgcacac

SEQ ID NO: 840477 - DNA, 20 bp, mouse
gattctgggcatactgggct

SEQ ID NO: 840478 - DNA, 20 bp, mouse
gagaccgtgtctcaaatgat

SEQ ID NO: 840479 - DNA, 20 bp, mouse
gagcttgctgagttagttcc

SEQ ID NO: 840480 - DNA, 20 bp, mouse
ggtgtctcaaatgatagggt

SEQ ID NO: 840481 - DNA, 20 bp, mouse
gtgtcacacaagcatgagtt

SEQ ID NO: 840482 - DNA, 20 bp, mouse
gagtgtttggccttttatgt

SEQ ID NO: 840483 - DNA, 20 bp, mouse
gcccctgacacccacataaa

SEQ ID NO: 840484 - DNA, 20 bp, mouse
ggttggagagatgggtcact

SEQ ID NO: 840485 - DNA, 20 bp, mouse
gttgaaaaagattgagaggt

SEQ ID NO: 840486 - DNA, 20 bp, mouse
gtagccagagcagacacatg

SEQ ID NO: 840487 - DNA, 20 bp, mouse
ggtgtcctggagtcactccc

SEQ ID NO: 840488 - DNA, 20 bp, mouse
gctgctgcaccgctgctccg

SEQ ID NO: 840489 - DNA, 20 bp, mouse
gtgctccggggagtgactcc

SEQ ID NO: 840490 - DNA, 20 bp, mouse
gggtgggcattggatgtggg

SEQ ID NO: 840491 - DNA, 20 bp, mouse
gacacatgtggctatggggc

SEQ ID NO: 840492 - DNA, 20 bp, mouse
gcagcagccggaagctgggt

SEQ ID NO: 840493 - DNA, 20 bp, mouse
ggcagacacatgtggctatg

SEQ ID NO: 840494 - DNA, 20 bp, mouse
ggcccacccaacccagcttc

SEQ ID NO: 840495 - DNA, 20 bp, mouse
gtagccacatgtgtctgctc

SEQ ID NO: 840496 - DNA, 20 bp, mouse
gacagaaagcggcagagcgt

SEQ ID NO: 840497 - DNA, 20 bp, mouse
gtgcagcctagagaatgggg

SEQ ID NO: 840498 - DNA, 20 bp, mouse
gcattctctaggctgcacaa

SEQ ID NO: 840499 - DNA, 20 bp, mouse
gcccccagcggacagatcta

SEQ ID NO: 840500 - DNA, 20 bp, mouse
gctctgtgtgggacagaaag

SEQ ID NO: 840501 - DNA, 20 bp, mouse
gacggtggaactcttgcgag

SEQ ID NO: 840502 - DNA, 20 bp, mouse
ggaatcgtggattcccagaa

SEQ ID NO: 840503 - DNA, 20 bp, mouse
gcggcagagcgtgggtcgcg

SEQ ID NO: 840504 - DNA, 20 bp, mouse
gcgcaaacttgtcgacacgg

SEQ ID NO: 840505 - DNA, 20 bp, mouse
ggtatggtcagagtccatag

SEQ ID NO: 840506 - DNA, 20 bp, mouse
gaacccaggctgtcaccaga

SEQ ID NO: 840507 - DNA, 20 bp, mouse
gtgagcggcgtagcaggaag

SEQ ID NO: 840508 - DNA, 20 bp, mouse
gcagacaccagagccaaccc

SEQ ID NO: 840509 - DNA, 20 bp, mouse
gtgggaccggagctggccta

SEQ ID NO: 840510 - DNA, 20 bp, mouse
gctgacggatggcgtcacca

SEQ ID NO: 840511 - DNA, 20 bp, mouse
gaagtggcccaggtggactt

SEQ ID NO: 840512 - DNA, 20 bp, mouse
gcagcggcgcgaacaacgct

SEQ ID NO: 840513 - DNA, 20 bp, mouse
gcaggaagaggctcaggcgg

SEQ ID NO: 840514 - DNA, 20 bp, mouse
gtccggtcccaagtccacct

SEQ ID NO: 840515 - DNA, 20 bp, mouse
gaaccttctggtgacagcct

SEQ ID NO: 840516 - DNA, 20 bp, mouse
gtgggaacggacatgagcaa

SEQ ID NO: 840517 - DNA, 20 bp, mouse
gcgcgcttggtgcacgctca

SEQ ID NO: 840518 - DNA, 20 bp, mouse
gcaagcgcgcatttggagcg

SEQ ID NO: 840519 - DNA, 20 bp, mouse
gaggtcagagtctttgccaa

SEQ ID NO: 840520 - DNA, 20 bp, mouse
gagagagctagttccacctt

SEQ ID NO: 840521 - DNA, 20 bp, mouse
gtgtgtgggtccacctgaag

SEQ ID NO: 840522 - DNA, 20 bp, mouse
gttggctaggtgagtcccca

SEQ ID NO: 840523 - DNA, 20 bp, mouse
gccaaaaccaaagctagggt

SEQ ID NO: 840524 - DNA, 20 bp, mouse
gggcaaagactctgaccttg

SEQ ID NO: 840525 - DNA, 20 bp, mouse
ggtcgaatgcagcactgtaa

SEQ ID NO: 840526 - DNA, 20 bp, mouse
gccctcctaaggggatgcta

SEQ ID NO: 840527 - DNA, 20 bp, mouse
gagcgctcaggcctagttgt

SEQ ID NO: 840528 - DNA, 20 bp, mouse
gcaagcaccaggacctcgag

SEQ ID NO: 840529 - DNA, 20 bp, mouse
ggggtcctctacccacaact

SEQ ID NO: 840530 - DNA, 20 bp, mouse
gaagaataagacggggtgag

SEQ ID NO: 840531 - DNA, 20 bp, mouse
gagcgggaccaagaataaga

SEQ ID NO: 840532 - DNA, 20 bp, mouse
gcaggcctagttgtgggtag

SEQ ID NO: 840533 - DNA, 20 bp, mouse
ggcgcagtgggcaaatggtc

SEQ ID NO: 840534 - DNA, 20 bp, mouse
gcctgggcgcagtgggcaaa

SEQ ID NO: 840535 - DNA, 20 bp, mouse
ggggtgccatcccctcctaa

SEQ ID NO: 840536 - DNA, 20 bp, mouse
ggggacctgggcactagcga

SEQ ID NO: 840537 - DNA, 20 bp, mouse
gagggcaggcagtgctcacc

SEQ ID NO: 840538 - DNA, 20 bp, mouse
gaagccccacaccccgagtg

SEQ ID NO: 840539 - DNA, 20 bp, mouse
ggcgtggcgcgtctgagggc

SEQ ID NO: 840540 - DNA, 20 bp, mouse
gggcaggcgtggcgcgtctg

SEQ ID NO: 840541 - DNA, 20 bp, mouse
gcaatgcatggtgcaggcga

SEQ ID NO: 840542 - DNA, 20 bp, mouse
gcacagcagcacgcgcttta

SEQ ID NO: 840543 - DNA, 20 bp, mouse
gtgctgctgtggccgagcgg

SEQ ID NO: 840544 - DNA, 20 bp, mouse
ggcgccccactcggggtgtg

SEQ ID NO: 840545 - DNA, 20 bp, mouse
ggcagcacgcgctttagggc

SEQ ID NO: 840546 - DNA, 20 bp, mouse
gtcaagcaatcgactgacgt

SEQ ID NO: 840547 - DNA, 20 bp, mouse
gtgggggtacactcggctag

SEQ ID NO: 840548 - DNA, 20 bp, mouse
gaagtggcgccaagagagaa

SEQ ID NO: 840549 - DNA, 20 bp, mouse
gggtacactcggctagaggc

SEQ ID NO: 840550 - DNA, 20 bp, mouse
gtgggtcagagggaacctaa

SEQ ID NO: 840551 - DNA, 20 bp, mouse
gcccccacgctgggaagtgg

SEQ ID NO: 840552 - DNA, 20 bp, mouse
ggccgagtgtacccccacgc

SEQ ID NO: 840553 - DNA, 20 bp, mouse
ggccgccacttcccagcgtg

SEQ ID NO: 840554 - DNA, 20 bp, mouse
gcccagcgtgggggtacact

SEQ ID NO: 840555 - DNA, 20 bp, mouse
ggctgggaagtggcggcaag

SEQ ID NO: 840556 - DNA, 20 bp, mouse
gtctggcctccgttccacct

SEQ ID NO: 840557 - DNA, 20 bp, mouse
ggatgggagaggacctattt

SEQ ID NO: 840558 - DNA, 20 bp, mouse
gcactgccaatcagaggaac

SEQ ID NO: 840559 - DNA, 20 bp, mouse
gtctgttaggaaggcatgat

SEQ ID NO: 840560 - DNA, 20 bp, mouse
gagccgggctgtaaggatgt

SEQ ID NO: 840561 - DNA, 20 bp, mouse
ggggcacggggctcaagttc

SEQ ID NO: 840562 - DNA, 20 bp, mouse
gtacagcccggctctgtgat

SEQ ID NO: 840563 - DNA, 20 bp, mouse
gttgacaggcccatttggtt

SEQ ID NO: 840564 - DNA, 20 bp, mouse
ggtctgtgatactcccaaat

SEQ ID NO: 840565 - DNA, 20 bp, mouse
gcggtaaagcctcttctgaa

SEQ ID NO: 840566 - DNA, 20 bp, mouse
ggcaccggagggcaccacgt

SEQ ID NO: 840567 - DNA, 20 bp, mouse
gggtaaccgcagccagtccc

SEQ ID NO: 840568 - DNA, 20 bp, mouse
gtaccctggtgagcaccgga

SEQ ID NO: 840569 - DNA, 20 bp, mouse
gcacgtgggcttctttaaga

SEQ ID NO: 840570 - DNA, 20 bp, mouse
gaagcccacgtggtgccctc

SEQ ID NO: 840571 - DNA, 20 bp, mouse
gtgccctccggtgctcacca

SEQ ID NO: 840572 - DNA, 20 bp, mouse
gccgtgccccgccggtgcaa

SEQ ID NO: 840573 - DNA, 20 bp, mouse
gcggttaccctggtgagcac

SEQ ID NO: 840574 - DNA, 20 bp, mouse
gcccgccggtgcaagggtca

SEQ ID NO: 840575 - DNA, 20 bp, mouse
gggcggggcacgggagatcg

SEQ ID NO: 840576 - DNA, 20 bp, mouse
gtgcagctgagttgggtttc

SEQ ID NO: 840577 - DNA, 20 bp, mouse
gccggctgtgcagctgagtt

SEQ ID NO: 840578 - DNA, 20 bp, mouse
ggctgagttgggtttcgggt

SEQ ID NO: 840579 - DNA, 20 bp, mouse
gtgacaccacctggtggccc

SEQ ID NO: 840580 - DNA, 20 bp, mouse
gatgtagaacactaggcata

SEQ ID NO: 840581 - DNA, 20 bp, mouse
gcgctcgagccgcgtgtagg

SEQ ID NO: 840582 - DNA, 20 bp, mouse
gtgacgctcgagccgcgtgt

SEQ ID NO: 840583 - DNA, 20 bp, mouse
ggtgtaggcggcgcccatcc

SEQ ID NO: 840584 - DNA, 20 bp, mouse
gaactttgtagtgctgactt

SEQ ID NO: 840585 - DNA, 20 bp, mouse
gcctcagctgatgtctggac

SEQ ID NO: 840586 - DNA, 20 bp, mouse
gcctagggagattagagtat

SEQ ID NO: 840587 - DNA, 20 bp, mouse
ggagtagcagatctgggatt

SEQ ID NO: 840588 - DNA, 20 bp, mouse
gacaataagtagtcttactc

SEQ ID NO: 840589 - DNA, 20 bp, mouse
ggcaaggttcatatttgtgt

SEQ ID NO: 840590 - DNA, 20 bp, mouse
gcaaatatgaaccttgccta

SEQ ID NO: 840591 - DNA, 20 bp, mouse
gagcaggtttggagtcagct

SEQ ID NO: 840592 - DNA, 20 bp, mouse
gcggttgccctctttcccaa

SEQ ID NO: 840593 - DNA, 20 bp, mouse
gccaacactgtcagactcaa

SEQ ID NO: 840594 - DNA, 20 bp, mouse
gtgtgcagacagacaccttt

SEQ ID NO: 840595 - DNA, 20 bp, mouse
gtattgacttagtcaacaaa

SEQ ID NO: 840596 - DNA, 20 bp, mouse
ggcggtcaccggaggcaatg

SEQ ID NO: 840597 - DNA, 20 bp, mouse
gctgctgcctgtgcaggtga

SEQ ID NO: 840598 - DNA, 20 bp, mouse
gcgttgctccgccctctcct

SEQ ID NO: 840599 - DNA, 20 bp, mouse
gaaagacccttcacctgcac

SEQ ID NO: 840600 - DNA, 20 bp, mouse
ggctcacgccgcattgcctc

SEQ ID NO: 840601 - DNA, 20 bp, mouse
gacaaaatgtgtcgtggaga

SEQ ID NO: 840602 - DNA, 20 bp, mouse
gtgcctccggtgaccgccag

SEQ ID NO: 840603 - DNA, 20 bp, mouse
gctcatgtcagtggtatgca

SEQ ID NO: 840604 - DNA, 20 bp, mouse
gagcgcctcagtgctgcctc

SEQ ID NO: 840605 - DNA, 20 bp, mouse
gtcccacctgctgcctgtgc

SEQ ID NO: 840606 - DNA, 20 bp, mouse
gcatgcacgaggctctgctc

SEQ ID NO: 840607 - DNA, 20 bp, mouse
gcacacccactccagaaatt

SEQ ID NO: 840608 - DNA, 20 bp, mouse
gcaggaattggctcaagagg

SEQ ID NO: 840609 - DNA, 20 bp, mouse
gatgttgatagcaaggatca

SEQ ID NO: 840610 - DNA, 20 bp, mouse
gtggggcgtgtcctcgccta

SEQ ID NO: 840611 - DNA, 20 bp, mouse
gttgagcccaatttctggag

SEQ ID NO: 840612 - DNA, 20 bp, mouse
gacacgccccaccatgcacg

SEQ ID NO: 840613 - DNA, 20 bp, mouse
gtcgcctagggctggatatg

SEQ ID NO: 840614 - DNA, 20 bp, mouse
gggcacgcaccatcaaacct

SEQ ID NO: 840615 - DNA, 20 bp, mouse
gaatagtggcccaggtttga

SEQ ID NO: 840616 - DNA, 20 bp, mouse
gaatgccaatggcagtccgg

SEQ ID NO: 840617 - DNA, 20 bp, mouse
gccgccccacacaatgctat

SEQ ID NO: 840618 - DNA, 20 bp, mouse
ggcggggccgaatgtccggg

SEQ ID NO: 840619 - DNA, 20 bp, mouse
ggcagagactgccctggtat

SEQ ID NO: 840620 - DNA, 20 bp, mouse
gcacccgcccgctcgccttc

SEQ ID NO: 840621 - DNA, 20 bp, mouse
ggagactgccctggtatggg

SEQ ID NO: 840622 - DNA, 20 bp, mouse
gcccacacaatgctattggt

SEQ ID NO: 840623 - DNA, 20 bp, mouse
gccagggcagtctctgcctc

SEQ ID NO: 840624 - DNA, 20 bp, mouse
gggtgggcctatggcggtgt

SEQ ID NO: 840625 - DNA, 20 bp, mouse
ggcggtgaacaaagaggcgg

SEQ ID NO: 840626 - DNA, 20 bp, mouse
gtgagatagtcaaggactga

SEQ ID NO: 840627 - DNA, 20 bp, mouse
gggtctgcatccaccggcca

SEQ ID NO: 840628 - DNA, 20 bp, mouse
gagagagtgggcatcccgcg

SEQ ID NO: 840629 - DNA, 20 bp, mouse
ggcccctggccccgcctcga

SEQ ID NO: 840630 - DNA, 20 bp, mouse
gacggagaccccaccctggc

SEQ ID NO: 840631 - DNA, 20 bp, mouse
gcatccttccggcagagagt

SEQ ID NO: 840632 - DNA, 20 bp, mouse
gcagggtggggtctccgtcg

SEQ ID NO: 840633 - DNA, 20 bp, mouse
gagacccggcgcctgcggtg

SEQ ID NO: 840634 - DNA, 20 bp, mouse
gcagcctggggcgcgagacc

SEQ ID NO: 840635 - DNA, 20 bp, mouse
gccgcgcggtctgcatccac

SEQ ID NO: 840636 - DNA, 20 bp, mouse
gtctacggatgctaggggga

SEQ ID NO: 840637 - DNA, 20 bp, mouse
gctcctgtcgcggcttctct

SEQ ID NO: 840638 - DNA, 20 bp, mouse
gccaccccataatggatgct

SEQ ID NO: 840639 - DNA, 20 bp, mouse
ggcaaagtctacggatgcta

SEQ ID NO: 840640 - DNA, 20 bp, mouse
gtgcccagagaagccgcgac

SEQ ID NO: 840641 - DNA, 20 bp, mouse
ggcgacaggagagtggtgat

SEQ ID NO: 840642 - DNA, 20 bp, mouse
gtagccgagcatccattatg

SEQ ID NO: 840643 - DNA, 20 bp, mouse
gagaagccgcgacaggagag

SEQ ID NO: 840644 - DNA, 20 bp, mouse
gaggccctggcccatcccca

SEQ ID NO: 840645 - DNA, 20 bp, mouse
gtcagacaaaggccgtgcaa

SEQ ID NO: 840646 - DNA, 20 bp, mouse
ggcaacgggtactgtcgcag

SEQ ID NO: 840647 - DNA, 20 bp, mouse
ggccgggcgcccagtggacg

SEQ ID NO: 840648 - DNA, 20 bp, mouse
ggcgggcccacgcagggagg

SEQ ID NO: 840649 - DNA, 20 bp, mouse
gcccgcgcgcgggcccacgc

SEQ ID NO: 840650 - DNA, 20 bp, mouse
gcgcgcgggcccacgcaggg

SEQ ID NO: 840651 - DNA, 20 bp, mouse
gcggagccccctccctgcgt

SEQ ID NO: 840652 - DNA, 20 bp, mouse
gttgccgccccgcattgcag

SEQ ID NO: 840653 - DNA, 20 bp, mouse
ggggcgcgccgctgcaatgc

SEQ ID NO: 840654 - DNA, 20 bp, mouse
ggcgccgctgcaatgcgggg

SEQ ID NO: 840655 - DNA, 20 bp, mouse
gcgcgccatgctgcagacag

SEQ ID NO: 840656 - DNA, 20 bp, mouse
gacacccagggtccacgcca

SEQ ID NO: 840657 - DNA, 20 bp, mouse
gtggccctggcgtggaccct

SEQ ID NO: 840658 - DNA, 20 bp, mouse
gcgtagaaggagctggaagt

SEQ ID NO: 840659 - DNA, 20 bp, mouse
gccgacgcgtggcccggcca

SEQ ID NO: 840660 - DNA, 20 bp, mouse
gctggccggaagaaagtccc

SEQ ID NO: 840661 - DNA, 20 bp, mouse
gccgcagcgaagccgatgat

SEQ ID NO: 840662 - DNA, 20 bp, mouse
gatcagctgtgagtccccgg

SEQ ID NO: 840663 - DNA, 20 bp, mouse
ggagccagagaggtgacccg

SEQ ID NO: 840664 - DNA, 20 bp, mouse
ggccgggccacgcgtcggga

SEQ ID NO: 840665 - DNA, 20 bp, mouse
gcagcgaagccgatgattgg

SEQ ID NO: 840666 - DNA, 20 bp, mouse
gatagtgtgcagggctgcta

SEQ ID NO: 840667 - DNA, 20 bp, mouse
ggaggagcatctgaaaatgg

SEQ ID NO: 840668 - DNA, 20 bp, mouse
gcaacagtccaggacggatg

SEQ ID NO: 840669 - DNA, 20 bp, mouse
gtggagggggacaagcattg

SEQ ID NO: 840670 - DNA, 20 bp, mouse
ggccgcccctaaggcgctct

SEQ ID NO: 840671 - DNA, 20 bp, mouse
ggcccagagcgccttagggg

SEQ ID NO: 840672 - DNA, 20 bp, mouse
ggaggtacggatagtgtgca

SEQ ID NO: 840673 - DNA, 20 bp, mouse
ggctctgggccaatgagccc

SEQ ID NO: 840674 - DNA, 20 bp, mouse
gtcccactaatgattggatg

SEQ ID NO: 840675 - DNA, 20 bp, mouse
gctggactccacatccgtcc

SEQ ID NO: 840676 - DNA, 20 bp, mouse
gaggggagagaacttaggat

SEQ ID NO: 840677 - DNA, 20 bp, mouse
gtctgcgcatccctgacatc

SEQ ID NO: 840678 - DNA, 20 bp, mouse
gtctgcgcatgcgtgacctg

SEQ ID NO: 840679 - DNA, 20 bp, mouse
gcggctttgcgcaggacaag

SEQ ID NO: 840680 - DNA, 20 bp, mouse
ggtcacgcatgcgcagacca

SEQ ID NO: 840681 - DNA, 20 bp, mouse
gaggcgaggtgagacatggc

SEQ ID NO: 840682 - DNA, 20 bp, mouse
ggatgtggctcaatttgaag

SEQ ID NO: 840683 - DNA, 20 bp, mouse
ggaacttaggatcgggagac

SEQ ID NO: 840684 - DNA, 20 bp, mouse
gtgcgcaaagccggatgtca

SEQ ID NO: 840685 - DNA, 20 bp, mouse
ggcgtctcgggggcaggctt

SEQ ID NO: 840686 - DNA, 20 bp, mouse
gcagcccgcccaccatgggg

SEQ ID NO: 840687 - DNA, 20 bp, mouse
gccggattctctcacctgtc

SEQ ID NO: 840688 - DNA, 20 bp, mouse
gcggcgcagccaatctgtga

SEQ ID NO: 840689 - DNA, 20 bp, mouse
gcaccaggggagtgaaacct

SEQ ID NO: 840690 - DNA, 20 bp, mouse
gcaggtgagagaatccggag

SEQ ID NO: 840691 - DNA, 20 bp, mouse
ggcagagacgcagggtgcgg

SEQ ID NO: 840692 - DNA, 20 bp, mouse
gaggcggcggtctgctgtaa

SEQ ID NO: 840693 - DNA, 20 bp, mouse
gagagaatccggagcggcaa

SEQ ID NO: 840694 - DNA, 20 bp, mouse
gaaggggaggggatacgcct

SEQ ID NO: 840695 - DNA, 20 bp, mouse
gttctctcacctgtcgggtt

SEQ ID NO: 840696 - DNA, 20 bp, mouse
gggactagggagcctctggt

SEQ ID NO: 840697 - DNA, 20 bp, mouse
gacagtgcccgcggagggga

SEQ ID NO: 840698 - DNA, 20 bp, mouse
ggcacctcccctcccaccag

SEQ ID NO: 840699 - DNA, 20 bp, mouse
gcccgcggaggggagggacc

SEQ ID NO: 840700 - DNA, 20 bp, mouse
gggacctgggtaggtcacaa

SEQ ID NO: 840701 - DNA, 20 bp, mouse
gggcccagcatgtctgtctc

SEQ ID NO: 840702 - DNA, 20 bp, mouse
ggtggtggaagcagaagcgt

SEQ ID NO: 840703 - DNA, 20 bp, mouse
gtggcctcggagtggatgcg

SEQ ID NO: 840704 - DNA, 20 bp, mouse
gcggttgtgacacactgcga

SEQ ID NO: 840705 - DNA, 20 bp, mouse
ggtgacacactgcgagggag

SEQ ID NO: 840706 - DNA, 20 bp, mouse
gcggaaatgactccacctga

SEQ ID NO: 840707 - DNA, 20 bp, mouse
gaccttgtttaggcccagta

SEQ ID NO: 840708 - DNA, 20 bp, mouse
gtagaagactaaggtgtagt

SEQ ID NO: 840709 - DNA, 20 bp, mouse
gatggcaagccagccatact

SEQ ID NO: 840710 - DNA, 20 bp, mouse
gtgtttaggcccagtatggc

SEQ ID NO: 840711 - DNA, 20 bp, mouse
gtcactaacttagaagacta

SEQ ID NO: 840712 - DNA, 20 bp, mouse
gaacgctggagtctgtcctc

SEQ ID NO: 840713 - DNA, 20 bp, mouse
gtctgtcctctggtctccca

SEQ ID NO: 840714 - DNA, 20 bp, mouse
ggggggcaaatggatcccta

SEQ ID NO: 840715 - DNA, 20 bp, mouse
gacttcatcacaccttgttt

SEQ ID NO: 840716 - DNA, 20 bp, mouse
ggggtcatggctgaatgaag

SEQ ID NO: 840717 - DNA, 20 bp, mouse
ggggtgacatccatgggtca

SEQ ID NO: 840718 - DNA, 20 bp, mouse
gacccctcttaccctgactg

SEQ ID NO: 840719 - DNA, 20 bp, mouse
ggggtgacatccacgaatta

SEQ ID NO: 840720 - DNA, 20 bp, mouse
ggaggcttcctctatgtggc

SEQ ID NO: 840721 - DNA, 20 bp, mouse
gtgagagcaggtctgtgaga

SEQ ID NO: 840722 - DNA, 20 bp, mouse
gcccagaggctgttgagagc

SEQ ID NO: 840723 - DNA, 20 bp, mouse
gctagatatgagttcagctg

SEQ ID NO: 840724 - DNA, 20 bp, mouse
gttcctcagtcagggtaaga

SEQ ID NO: 840725 - DNA, 20 bp, mouse
ggctctcccaattggcccag

SEQ ID NO: 840726 - DNA, 20 bp, mouse
gaccctaggaggctggatac

SEQ ID NO: 840727 - DNA, 20 bp, mouse
gggactgcggcaccgcgaga

SEQ ID NO: 840728 - DNA, 20 bp, mouse
gcgcctgtatccagcctcct

SEQ ID NO: 840729 - DNA, 20 bp, mouse
ggaggggaaaccagcaggac

SEQ ID NO: 840730 - DNA, 20 bp, mouse
gggggcgtaataaccctagg

SEQ ID NO: 840731 - DNA, 20 bp, mouse
gccagtcccgctgacgtcat

SEQ ID NO: 840732 - DNA, 20 bp, mouse
gacctcaggtggacactgag

SEQ ID NO: 840733 - DNA, 20 bp, mouse
gactctggggactacagatg

SEQ ID NO: 840734 - DNA, 20 bp, mouse
ggaaaccagcaggaccggct

SEQ ID NO: 840735 - DNA, 20 bp, mouse
gggggcgcggtgcgaggtgc

SEQ ID NO: 840736 - DNA, 20 bp, mouse
ggcgaggagtggggcttctt

SEQ ID NO: 840737 - DNA, 20 bp, mouse
gagccccagggacggtcttg

SEQ ID NO: 840738 - DNA, 20 bp, mouse
gaagctgagtgtggggaact

SEQ ID NO: 840739 - DNA, 20 bp, mouse
gggcttgtggccaatcagcg

SEQ ID NO: 840740 - DNA, 20 bp, mouse
gcagcccccaagaccgtccc

SEQ ID NO: 840741 - DNA, 20 bp, mouse
gcgggcgtgaagaccttgcg

SEQ ID NO: 840742 - DNA, 20 bp, mouse
ggtcttgggggctggactat

SEQ ID NO: 840743 - DNA, 20 bp, mouse
ggaagaccttgcgaggagtg

SEQ ID NO: 840744 - DNA, 20 bp, mouse
ggggctggactatgggcttg

SEQ ID NO: 840745 - DNA, 20 bp, mouse
gaagactgcggtagtgtggc

SEQ ID NO: 840746 - DNA, 20 bp, mouse
gtactggggtggggcactaa

SEQ ID NO: 840747 - DNA, 20 bp, mouse
gtggccgcgccttcggagga

SEQ ID NO: 840748 - DNA, 20 bp, mouse
gcggtgggcaatccgctctg

SEQ ID NO: 840749 - DNA, 20 bp, mouse
gcggaggaggggccaccggt

SEQ ID NO: 840750 - DNA, 20 bp, mouse
gtgcgggcggatctcggtgc

SEQ ID NO: 840751 - DNA, 20 bp, mouse
gggcccctcctccgaaggcg

SEQ ID NO: 840752 - DNA, 20 bp, mouse
ggctggagcgccgcacaatg

SEQ ID NO: 840753 - DNA, 20 bp, mouse
ggggacgctagtcaggacgg

SEQ ID NO: 840754 - DNA, 20 bp, mouse
gggttctattgtccccagag

SEQ ID NO: 840755 - DNA, 20 bp, mouse
gagtctggccgcgccttcgg

SEQ ID NO: 840756 - DNA, 20 bp, mouse
ggggactggagtaatggagg

SEQ ID NO: 840757 - DNA, 20 bp, mouse
gcctgaggggaaactagagt

SEQ ID NO: 840758 - DNA, 20 bp, mouse
gggagggactggagtaatgg

SEQ ID NO: 840759 - DNA, 20 bp, mouse
ggagcacgcgggtgacccag

SEQ ID NO: 840760 - DNA, 20 bp, mouse
ggaggggcctcggaaaagta

SEQ ID NO: 840761 - DNA, 20 bp, mouse
gccgcctcctgggcccgcct

SEQ ID NO: 840762 - DNA, 20 bp, mouse
ggggatacaccgggaccctg

SEQ ID NO: 840763 - DNA, 20 bp, mouse
gaactagagtggggatacac

SEQ ID NO: 840764 - DNA, 20 bp, mouse
gcatcctaggcgggcccagg

SEQ ID NO: 840765 - DNA, 20 bp, mouse
gcagagaaagagcttgacgg

SEQ ID NO: 840766 - DNA, 20 bp, mouse
gcagggcggggattgtgata

SEQ ID NO: 840767 - DNA, 20 bp, mouse
gagctgctgcggggagagaa

SEQ ID NO: 840768 - DNA, 20 bp, mouse
gcccgcgcgctgcactgcgg

SEQ ID NO: 840769 - DNA, 20 bp, mouse
ggacgagggcgggtcataag

SEQ ID NO: 840770 - DNA, 20 bp, mouse
gctctcggagtgctcccagg

SEQ ID NO: 840771 - DNA, 20 bp, mouse
ggacccgccctcgtcagcac

SEQ ID NO: 840772 - DNA, 20 bp, mouse
gcgggcaggcattgtcgatc

SEQ ID NO: 840773 - DNA, 20 bp, mouse
gtgcccagtgcgtcccggaa

SEQ ID NO: 840774 - DNA, 20 bp, mouse
gcagcgcagccaatagtgtc

SEQ ID NO: 840775 - DNA, 20 bp, mouse
ggggcccttccgggacgcac

SEQ ID NO: 840776 - DNA, 20 bp, mouse
gtggctagaaactggggtat

SEQ ID NO: 840777 - DNA, 20 bp, mouse
gtctaggaaaatctgatgtg

SEQ ID NO: 840778 - DNA, 20 bp, mouse
gtcctcagaaagttcctgtg

SEQ ID NO: 840779 - DNA, 20 bp, mouse
ggtgctcttctgtttatctg

SEQ ID NO: 840780 - DNA, 20 bp, mouse
ggaactgcagagtcatgaac

SEQ ID NO: 840781 - DNA, 20 bp, mouse
gctctctttgcaaccactct

SEQ ID NO: 840782 - DNA, 20 bp, mouse
gatggggctgtagagttcaa

SEQ ID NO: 840783 - DNA, 20 bp, mouse
gtctgcatgctaagacatat

SEQ ID NO: 840784 - DNA, 20 bp, mouse
gaggaagcttggctagaaac

SEQ ID NO: 840785 - DNA, 20 bp, mouse
gagaggagcacttcgggagg

SEQ ID NO: 840786 - DNA, 20 bp, mouse
gtggccgcctggcacgtgat

SEQ ID NO: 840787 - DNA, 20 bp, mouse
gaaaagactgcgctcgccac

SEQ ID NO: 840788 - DNA, 20 bp, mouse
ggccgggggcgggagatagg

SEQ ID NO: 840789 - DNA, 20 bp, mouse
ggcaaaaagaagttaggaat

SEQ ID NO: 840790 - DNA, 20 bp, mouse
gggcgagcgcagtctttttt

SEQ ID NO: 840791 - DNA, 20 bp, mouse
gcgcctggcacgtgatcggt

SEQ ID NO: 840792 - DNA, 20 bp, mouse
ggaccaaccgatcacgtgcc

SEQ ID NO: 840793 - DNA, 20 bp, mouse
gcacgctgcaaaaagaagtt

SEQ ID NO: 840794 - DNA, 20 bp, mouse
gaatcagcgactggttgggt

SEQ ID NO: 840795 - DNA, 20 bp, mouse
ggcggccgggggcgggagat

SEQ ID NO: 840796 - DNA, 20 bp, mouse
gggactggaggggactcccg

SEQ ID NO: 840797 - DNA, 20 bp, mouse
gtggaggggactcccgagga

SEQ ID NO: 840798 - DNA, 20 bp, mouse
gaccgtggtgcagaagtcta

SEQ ID NO: 840799 - DNA, 20 bp, mouse
gcctcccaaagactagcggg

SEQ ID NO: 840800 - DNA, 20 bp, mouse
gcctctctgcccgacgccca

SEQ ID NO: 840801 - DNA, 20 bp, mouse
gaggaccaagagcggggctt

SEQ ID NO: 840802 - DNA, 20 bp, mouse
gggaaccgcccgctagtctt

SEQ ID NO: 840803 - DNA, 20 bp, mouse
gagctggaaccctgggcgtc

SEQ ID NO: 840804 - DNA, 20 bp, mouse
gccgagcggggtcaagtccc

SEQ ID NO: 840805 - DNA, 20 bp, mouse
gccacccgcagggttatggg

SEQ ID NO: 840806 - DNA, 20 bp, mouse
gagctcccggggccaggtac

SEQ ID NO: 840807 - DNA, 20 bp, mouse
gaacttgaggagccagtctg

SEQ ID NO: 840808 - DNA, 20 bp, mouse
ggcagcagccgtggagtctg

SEQ ID NO: 840809 - DNA, 20 bp, mouse
gcgggcccatgaggcgacga

SEQ ID NO: 840810 - DNA, 20 bp, mouse
gggctcctcaagttcagctc

SEQ ID NO: 840811 - DNA, 20 bp, mouse
ggtccccggggtatgggcgg

SEQ ID NO: 840812 - DNA, 20 bp, mouse
gggacccgccgcagactcca

SEQ ID NO: 840813 - DNA, 20 bp, mouse
gcccggggccaggtactggc

SEQ ID NO: 840814 - DNA, 20 bp, mouse
ggcagccgtggagtctgcgg

SEQ ID NO: 840815 - DNA, 20 bp, mouse
gggaagcctggtgtgcccga

SEQ ID NO: 840816 - DNA, 20 bp, mouse
ggatgctcaaggatgttgac

SEQ ID NO: 840817 - DNA, 20 bp, mouse
gcggaggccctggtaactga

SEQ ID NO: 840818 - DNA, 20 bp, mouse
gacagtgggtccgatttctc

SEQ ID NO: 840819 - DNA, 20 bp, mouse
gggcccagtcgctatggtaa

SEQ ID NO: 840820 - DNA, 20 bp, mouse
ggccggaggcccagtcgcta

SEQ ID NO: 840821 - DNA, 20 bp, mouse
ggggtaactaggtttcagag

SEQ ID NO: 840822 - DNA, 20 bp, mouse
gaacaagggcattacgacat

SEQ ID NO: 840823 - DNA, 20 bp, mouse
gggactttaactttgatcac

SEQ ID NO: 840824 - DNA, 20 bp, mouse
ggggcatcatcctgagaaat

SEQ ID NO: 840825 - DNA, 20 bp, mouse
gtgagcatctgcagctccgg

SEQ ID NO: 840826 - DNA, 20 bp, mouse
gcgcgcatgcgcagacgctc

SEQ ID NO: 840827 - DNA, 20 bp, mouse
gccggtgcgcattcatcaga

SEQ ID NO: 840828 - DNA, 20 bp, mouse
gcatgcgcgcgtgggcgttc

SEQ ID NO: 840829 - DNA, 20 bp, mouse
gtggagcggagaacgattag

SEQ ID NO: 840830 - DNA, 20 bp, mouse
gcacgactgaagcccgatga

SEQ ID NO: 840831 - DNA, 20 bp, mouse
gactgcgcagaagcacgatt

SEQ ID NO: 840832 - DNA, 20 bp, mouse
gcagaagcacgatttggctg

SEQ ID NO: 840833 - DNA, 20 bp, mouse
gcgtctgcgcatgcgcgcgt

SEQ ID NO: 840834 - DNA, 20 bp, mouse
gtcagcagccacaacatccg

SEQ ID NO: 840835 - DNA, 20 bp, mouse
ggccgtggccccggatgttg

SEQ ID NO: 840836 - DNA, 20 bp, mouse
gcgcaagcgcacatagtgac

SEQ ID NO: 840837 - DNA, 20 bp, mouse
gcgaggatccccaggggtgt

SEQ ID NO: 840838 - DNA, 20 bp, mouse
gggccagccgaggatcccca

SEQ ID NO: 840839 - DNA, 20 bp, mouse
gtgcagctggaattcagcac

SEQ ID NO: 840840 - DNA, 20 bp, mouse
gcaggtggatgcaccaagtg

SEQ ID NO: 840841 - DNA, 20 bp, mouse
gacccctggggatcctcggc

SEQ ID NO: 840842 - DNA, 20 bp, mouse
gtagcatatccggcaggtgt

SEQ ID NO: 840843 - DNA, 20 bp, mouse
gcacatagtgacaggaagcg

SEQ ID NO: 840844 - DNA, 20 bp, mouse
gcctctccgcagccggcggg

SEQ ID NO: 840845 - DNA, 20 bp, mouse
gtcagcacaggcgcagagcg

SEQ ID NO: 840846 - DNA, 20 bp, mouse
gcccgtggagaggaaccctg

SEQ ID NO: 840847 - DNA, 20 bp, mouse
gcacgcggcgcgaatcggaa

SEQ ID NO: 840848 - DNA, 20 bp, mouse
ggagaggaaccctgcggctg

SEQ ID NO: 840849 - DNA, 20 bp, mouse
ggcccttcggccaccgtcgg

SEQ ID NO: 840850 - DNA, 20 bp, mouse
ggacgcgcggaggtgagtca

SEQ ID NO: 840851 - DNA, 20 bp, mouse
gcgaaccgctgcccgtggag

SEQ ID NO: 840852 - DNA, 20 bp, mouse
gcacggcacgcggcgcgaat

SEQ ID NO: 840853 - DNA, 20 bp, mouse
ggacctgtggaccggatcaa

SEQ ID NO: 840854 - DNA, 20 bp, mouse
gcaggcgggaatatagtgca

SEQ ID NO: 840855 - DNA, 20 bp, mouse
gaggtgcgtgacaacccggg

SEQ ID NO: 840856 - DNA, 20 bp, mouse
ggcgcccagaccgcaagctg

SEQ ID NO: 840857 - DNA, 20 bp, mouse
ggcaagctgcggacgcgtac

SEQ ID NO: 840858 - DNA, 20 bp, mouse
gctcgtaagtgagttctcag

SEQ ID NO: 840859 - DNA, 20 bp, mouse
ggggcgccggactactacgc

SEQ ID NO: 840860 - DNA, 20 bp, mouse
gcgctgcttgtgaacagcac

SEQ ID NO: 840861 - DNA, 20 bp, mouse
gagagccctgcgtagtagtc

SEQ ID NO: 840862 - DNA, 20 bp, mouse
gtacctcctggtgacgtcaa

SEQ ID NO: 840863 - DNA, 20 bp, mouse
gcggcgcccctgtccctgtg

SEQ ID NO: 840864 - DNA, 20 bp, mouse
gtggtgacgtcaaggggcag

SEQ ID NO: 840865 - DNA, 20 bp, mouse
ggcgctggaaaagtcgttgc

SEQ ID NO: 840866 - DNA, 20 bp, mouse
gcggacttccggcttgagag

SEQ ID NO: 840867 - DNA, 20 bp, mouse
gggactgaggctagcccagg

SEQ ID NO: 840868 - DNA, 20 bp, mouse
gagaagcccgctcggacttc

SEQ ID NO: 840869 - DNA, 20 bp, mouse
ggccgtcgcgcatgcgtcct

SEQ ID NO: 840870 - DNA, 20 bp, mouse
gtcaagccggaagtccgagc

SEQ ID NO: 840871 - DNA, 20 bp, mouse
gtgggccggcgggagtcctc

SEQ ID NO: 840872 - DNA, 20 bp, mouse
ggggtcactctgggagacgt

SEQ ID NO: 840873 - DNA, 20 bp, mouse
ggtgaagcgaggaagctcga

SEQ ID NO: 840874 - DNA, 20 bp, mouse
ggcgtcctgaggactcccgc

SEQ ID NO: 840875 - DNA, 20 bp, mouse
gaagctggttgagagagacg

SEQ ID NO: 840876 - DNA, 20 bp, mouse
gcagccccggagctgtgcct

SEQ ID NO: 840877 - DNA, 20 bp, mouse
gtttcccaggcacagctccg

SEQ ID NO: 840878 - DNA, 20 bp, mouse
gtgcctgggaaaggtgctga

SEQ ID NO: 840879 - DNA, 20 bp, mouse
ggctggatgcggtgcgtccg

SEQ ID NO: 840880 - DNA, 20 bp, mouse
ggaaaccccggtgccgggac

SEQ ID NO: 840881 - DNA, 20 bp, mouse
ggcaccggggtttcgagatg

SEQ ID NO: 840882 - DNA, 20 bp, mouse
ggatgcggtgcgtccgtggg

SEQ ID NO: 840883 - DNA, 20 bp, mouse
gtccgcccgtcccggcaccg

SEQ ID NO: 840884 - DNA, 20 bp, mouse
gccggggtttcgagatgtgg

SEQ ID NO: 840885 - DNA, 20 bp, mouse
gtatcaggatctctgctaag

SEQ ID NO: 840886 - DNA, 20 bp, mouse
gtgggccgcagacgggacgt

SEQ ID NO: 840887 - DNA, 20 bp, mouse
gtggcgtcacacccacgcga

SEQ ID NO: 840888 - DNA, 20 bp, mouse
gaggcctcgcccacttaggg

SEQ ID NO: 840889 - DNA, 20 bp, mouse
gcagacgggacgtaggtctc

SEQ ID NO: 840890 - DNA, 20 bp, mouse
ggtgaggcacacaggggcaa

SEQ ID NO: 840891 - DNA, 20 bp, mouse
gcatcaggcccgccctaagt

SEQ ID NO: 840892 - DNA, 20 bp, mouse
gctgaggcctcgcccactta

SEQ ID NO: 840893 - DNA, 20 bp, mouse
gcgcttgaaatcggtcaagg

SEQ ID NO: 840894 - DNA, 20 bp, mouse
gggacgtaggtctcgggcca

SEQ ID NO: 840895 - DNA, 20 bp, mouse
ggcatcttggataatttgat

SEQ ID NO: 840896 - DNA, 20 bp, mouse
ggccccctcaggctgaactg

SEQ ID NO: 840897 - DNA, 20 bp, mouse
gcgggcatggagcggaagag

SEQ ID NO: 840898 - DNA, 20 bp, mouse
gaatgcacgagcgcccccga

SEQ ID NO: 840899 - DNA, 20 bp, mouse
gggggcgctcgtgcattatg

SEQ ID NO: 840900 - DNA, 20 bp, mouse
gtgacccaagcccgctgccc

SEQ ID NO: 840901 - DNA, 20 bp, mouse
gaacacccataagccttcgg

SEQ ID NO: 840902 - DNA, 20 bp, mouse
gctcctaaagcggccccctc

SEQ ID NO: 840903 - DNA, 20 bp, mouse
gggggtttctggtgtctcgc

SEQ ID NO: 840904 - DNA, 20 bp, mouse
gttccacagttcagcctgag

SEQ ID NO: 840905 - DNA, 20 bp, mouse
ggagcggaagagggggtttc

SEQ ID NO: 840906 - DNA, 20 bp, mouse
gaaactagacttatatggta

SEQ ID NO: 840907 - DNA, 20 bp, mouse
gagacttatatggtagggag

SEQ ID NO: 840908 - DNA, 20 bp, mouse
ggaaaaagcacctgccagac

SEQ ID NO: 840909 - DNA, 20 bp, mouse
gtagtctaagccagtctggc

SEQ ID NO: 840910 - DNA, 20 bp, mouse
gctggctttgacttcgacct

SEQ ID NO: 840911 - DNA, 20 bp, mouse
gcttatatggtagggagagg

SEQ ID NO: 840912 - DNA, 20 bp, mouse
gtgcagaaactagacttata

SEQ ID NO: 840913 - DNA, 20 bp, mouse
gggactagtctaagccagtc

SEQ ID NO: 840914 - DNA, 20 bp, mouse
gtcgacctgggctacttgcc

SEQ ID NO: 840915 - DNA, 20 bp, mouse
gttttcctggcaagtagccc

SEQ ID NO: 840916 - DNA, 20 bp, mouse
gctccagagcttcccttcaa

SEQ ID NO: 840917 - DNA, 20 bp, mouse
gcgctgtagtgaggagagct

SEQ ID NO: 840918 - DNA, 20 bp, mouse
gcttcccggccgctgtagtg

SEQ ID NO: 840919 - DNA, 20 bp, mouse
gcccgcaccactgacatctt

SEQ ID NO: 840920 - DNA, 20 bp, mouse
gaaccattgaagggaagctc

SEQ ID NO: 840921 - DNA, 20 bp, mouse
gcggggtgctggagagtaaa

SEQ ID NO: 840922 - DNA, 20 bp, mouse
gtagccagggccttcctgtg

SEQ ID NO: 840923 - DNA, 20 bp, mouse
gtacagcggccgggaagaaa

SEQ ID NO: 840924 - DNA, 20 bp, mouse
gacagtctggagggccactc

SEQ ID NO: 840925 - DNA, 20 bp, mouse
gcattggctgaaccattgaa

SEQ ID NO: 840926 - DNA, 20 bp, mouse
gcaccctcagtcctagacac

SEQ ID NO: 840927 - DNA, 20 bp, mouse
gacaagaagggcatggatcg

SEQ ID NO: 840928 - DNA, 20 bp, mouse
gggggcggtgtctagagctg

SEQ ID NO: 840929 - DNA, 20 bp, mouse
gtggagcacgtctaaggctg

SEQ ID NO: 840930 - DNA, 20 bp, mouse
gcaccgtctgcccacgcaga

SEQ ID NO: 840931 - DNA, 20 bp, mouse
gccagggcaccccgctccat

SEQ ID NO: 840932 - DNA, 20 bp, mouse
gctctctcctccttctgcgt

SEQ ID NO: 840933 - DNA, 20 bp, mouse
ggtccgctgccggctgacac

SEQ ID NO: 840934 - DNA, 20 bp, mouse
ggtcccgtgtcagccggcag

SEQ ID NO: 840935 - DNA, 20 bp, mouse
gggctgcagcacaaactccc

SEQ ID NO: 840936 - DNA, 20 bp, mouse
gactacaggcactggcccct

SEQ ID NO: 840937 - DNA, 20 bp, mouse
ggctggctatatagctctct

SEQ ID NO: 840938 - DNA, 20 bp, mouse
ggccagcctgggtcccttta

SEQ ID NO: 840939 - DNA, 20 bp, mouse
ggaacaagctcaatgcccag

SEQ ID NO: 840940 - DNA, 20 bp, mouse
gaggcggatcccttgttctg

SEQ ID NO: 840941 - DNA, 20 bp, mouse
gtagagcttagaatctataa

SEQ ID NO: 840942 - DNA, 20 bp, mouse
gagagtcaacattccttaaa

SEQ ID NO: 840943 - DNA, 20 bp, mouse
ggcagtcagtgcttttttct

SEQ ID NO: 840944 - DNA, 20 bp, mouse
gattcagaatccccagaaca

SEQ ID NO: 840945 - DNA, 20 bp, mouse
ggtgctggaactacaggcac

SEQ ID NO: 840946 - DNA, 20 bp, mouse
gagttaaagactcccttctt

SEQ ID NO: 840947 - DNA, 20 bp, mouse
gggaggtaacatccgaagaa

SEQ ID NO: 840948 - DNA, 20 bp, mouse
gctctgcagcgtctactccc

SEQ ID NO: 840949 - DNA, 20 bp, mouse
gagaactccacccccaatac

SEQ ID NO: 840950 - DNA, 20 bp, mouse
gctccacccccaatacaggg

SEQ ID NO: 840951 - DNA, 20 bp, mouse
ggatgttacctccctgtatt

SEQ ID NO: 840952 - DNA, 20 bp, mouse
gccggagaacaggagatatc

SEQ ID NO: 840953 - DNA, 20 bp, mouse
gagcctctgttcttatctgt

SEQ ID NO: 840954 - DNA, 20 bp, mouse
gtagcttttctgtagatgac

SEQ ID NO: 840955 - DNA, 20 bp, mouse
gacaaaaagcttccttctcc

SEQ ID NO: 840956 - DNA, 20 bp, mouse
gaaggcgcgtgcgctagatc

SEQ ID NO: 840957 - DNA, 20 bp, mouse
gcagccccccggggttgggt

SEQ ID NO: 840958 - DNA, 20 bp, mouse
ggggagcagccccccggggt

SEQ ID NO: 840959 - DNA, 20 bp, mouse
gagaggggagcgtagggcac

SEQ ID NO: 840960 - DNA, 20 bp, mouse
ggatccccagcacccctctg

SEQ ID NO: 840961 - DNA, 20 bp, mouse
ggatccgggagcagcccccc

SEQ ID NO: 840962 - DNA, 20 bp, mouse
ggcactggaccaatgggcgt

SEQ ID NO: 840963 - DNA, 20 bp, mouse
gcttccgacccaaccccggg

SEQ ID NO: 840964 - DNA, 20 bp, mouse
gagtcggtggtcagatgctg

SEQ ID NO: 840965 - DNA, 20 bp, mouse
gggtgctggggatcgctctg

SEQ ID NO: 840966 - DNA, 20 bp, mouse
gggagatggtgcatcttgga

SEQ ID NO: 840967 - DNA, 20 bp, mouse
gcccttccctcaagcagagg

SEQ ID NO: 840968 - DNA, 20 bp, mouse
ggctctgctacacgcctagg

SEQ ID NO: 840969 - DNA, 20 bp, mouse
ggcctaggtggctggtttaa

SEQ ID NO: 840970 - DNA, 20 bp, mouse
gtaaaggcttgcatcgcaga

SEQ ID NO: 840971 - DNA, 20 bp, mouse
ggtgaggggactgatctgaa

SEQ ID NO: 840972 - DNA, 20 bp, mouse
gttggaccggtcttgggaga

SEQ ID NO: 840973 - DNA, 20 bp, mouse
gttggtccaaaggtgtgaac

SEQ ID NO: 840974 - DNA, 20 bp, mouse
gaagcccttccctcaagcag

SEQ ID NO: 840975 - DNA, 20 bp, mouse
ggtaaagcttggaccggtct

SEQ ID NO: 840976 - DNA, 20 bp, mouse
gcccaggggcgtcgtgtgtg

SEQ ID NO: 840977 - DNA, 20 bp, mouse
gcaggcccgcggggaagcgg

SEQ ID NO: 840978 - DNA, 20 bp, mouse
ggtgcccaccgcttccccgc

SEQ ID NO: 840979 - DNA, 20 bp, mouse
ggtcgcgggcggaggaagaa

SEQ ID NO: 840980 - DNA, 20 bp, mouse
gcccctgggcctgcggtcgc

SEQ ID NO: 840981 - DNA, 20 bp, mouse
gcgaccagaccggaccgatg

SEQ ID NO: 840982 - DNA, 20 bp, mouse
gctttccgggcacggacaca

SEQ ID NO: 840983 - DNA, 20 bp, mouse
gagcagcagagcgctcccca

SEQ ID NO: 840984 - DNA, 20 bp, mouse
gtggctgggcgctcggtcgc

SEQ ID NO: 840985 - DNA, 20 bp, mouse
gtaagtcgcaaagtatgcac

SEQ ID NO: 840986 - DNA, 20 bp, mouse
gtaaaggtctcgtcagtctg

SEQ ID NO: 840987 - DNA, 20 bp, mouse
gtacctccgcctttctggaa

SEQ ID NO: 840988 - DNA, 20 bp, mouse
gctcagaggctgaccaccac

SEQ ID NO: 840989 - DNA, 20 bp, mouse
ggacgtagagacaactatac

SEQ ID NO: 840990 - DNA, 20 bp, mouse
gagctgtcccagctgaccct

SEQ ID NO: 840991 - DNA, 20 bp, mouse
gagaagcctatgggtcccaa

SEQ ID NO: 840992 - DNA, 20 bp, mouse
gtccaggtcccagaagccta

SEQ ID NO: 840993 - DNA, 20 bp, mouse
ggctactgggccggagtttt

SEQ ID NO: 840994 - DNA, 20 bp, mouse
gctcccttccagaaaggcgg

SEQ ID NO: 840995 - DNA, 20 bp, mouse
gctggaggcagcgcatcctg

SEQ ID NO: 840996 - DNA, 20 bp, mouse
gcagcccagcgttgggtcag

SEQ ID NO: 840997 - DNA, 20 bp, mouse
gagtgggcgtggcgagaaag

SEQ ID NO: 840998 - DNA, 20 bp, mouse
ggaagccccggagagagcag

SEQ ID NO: 840999 - DNA, 20 bp, mouse
gcatccggttcaccaggaga

SEQ ID NO: 841000 - DNA, 20 bp, mouse
gggtcagaggtgaaagcaag

SEQ ID NO: 841001 - DNA, 20 bp, mouse
gttctggtgcaagaaggcag

SEQ ID NO: 841002 - DNA, 20 bp, mouse
gagagggacaagaatggcgc

SEQ ID NO: 841003 - DNA, 20 bp, mouse
gtagtgggcagcccagcgtt

SEQ ID NO: 841004 - DNA, 20 bp, mouse
gggaggtggaagaaaccccg

SEQ ID NO: 841005 - DNA, 20 bp, mouse
gcgtctccgctgctctctcc

SEQ ID NO: 841006 - DNA, 20 bp, mouse
gcgctggcccagatccctat

SEQ ID NO: 841007 - DNA, 20 bp, mouse
ggctgctgggttgattctct

SEQ ID NO: 841008 - DNA, 20 bp, mouse
ggcagaggcgtgatgctgct

SEQ ID NO: 841009 - DNA, 20 bp, mouse
gaaaaagagagatatttcca

SEQ ID NO: 841010 - DNA, 20 bp, mouse
ggcccagcctatagggatct

SEQ ID NO: 841011 - DNA, 20 bp, mouse
gagaaagcacacacctgagg

SEQ ID NO: 841012 - DNA, 20 bp, mouse
gggcccagatccctataggc

SEQ ID NO: 841013 - DNA, 20 bp, mouse
gtttccaaggagggcggaga

SEQ ID NO: 841014 - DNA, 20 bp, mouse
gcggttcctgggacctatta

SEQ ID NO: 841015 - DNA, 20 bp, mouse
gttaaccctcaacacttcgc

SEQ ID NO: 841016 - DNA, 20 bp, mouse
gtggaggaatatggcagcaa

SEQ ID NO: 841017 - DNA, 20 bp, mouse
gtctccaactagttaactgt

SEQ ID NO: 841018 - DNA, 20 bp, mouse
gctacgaacgaggtttctgg

SEQ ID NO: 841019 - DNA, 20 bp, mouse
gaataagcatcgtcgaaggg

SEQ ID NO: 841020 - DNA, 20 bp, mouse
gggccaataagcatcgtcga

SEQ ID NO: 841021 - DNA, 20 bp, mouse
gtcttcgggccaatcaacgc

SEQ ID NO: 841022 - DNA, 20 bp, mouse
gactctcaatcctacgaacg

SEQ ID NO: 841023 - DNA, 20 bp, mouse
gccacttccgtcaatgtagt

SEQ ID NO: 841024 - DNA, 20 bp, mouse
gcccgaaagtgttttagagc

SEQ ID NO: 841025 - DNA, 20 bp, mouse
gtggcctacagttaactagt

SEQ ID NO: 841026 - DNA, 20 bp, mouse
gagagccgagttcaacacgg

SEQ ID NO: 841027 - DNA, 20 bp, mouse
ggcaccctccgtgttgaact

SEQ ID NO: 841028 - DNA, 20 bp, mouse
gcatccttgggtatcctctc

SEQ ID NO: 841029 - DNA, 20 bp, mouse
ggactggggcggagccagag

SEQ ID NO: 841030 - DNA, 20 bp, mouse
ggcagtgcgcagtcgcggac

SEQ ID NO: 841031 - DNA, 20 bp, mouse
ggcgcagtcgcggactgggg

SEQ ID NO: 841032 - DNA, 20 bp, mouse
ggggagggatatgggggcta

SEQ ID NO: 841033 - DNA, 20 bp, mouse
gggagattgtgtagatagtg

SEQ ID NO: 841034 - DNA, 20 bp, mouse
ggcagtattgacatagaaat

SEQ ID NO: 841035 - DNA, 20 bp, mouse
gctgagagccgagttcaaca

SEQ ID NO: 841036 - DNA, 20 bp, mouse
ggacgcgggcggtaggaggc

SEQ ID NO: 841037 - DNA, 20 bp, mouse
ggacggacgcgggcggtagg

SEQ ID NO: 841038 - DNA, 20 bp, mouse
gggcggggctccatagtggg

SEQ ID NO: 841039 - DNA, 20 bp, mouse
gttgacgcagagactctgta

SEQ ID NO: 841040 - DNA, 20 bp, mouse
gaaagagctggtccacgcga

SEQ ID NO: 841041 - DNA, 20 bp, mouse
gagaccggaaggcgataggc

SEQ ID NO: 841042 - DNA, 20 bp, mouse
gagggcgcaactccagagac

SEQ ID NO: 841043 - DNA, 20 bp, mouse
gtggggcggggctccatagt

SEQ ID NO: 841044 - DNA, 20 bp, mouse
gggcaagggctgcacttcta

SEQ ID NO: 841045 - DNA, 20 bp, mouse
gtccacgcgacggacgcggg

SEQ ID NO: 841046 - DNA, 20 bp, mouse
ggccaatggcttaaggggcg

SEQ ID NO: 841047 - DNA, 20 bp, mouse
ggggggtgattgccgggaaa

SEQ ID NO: 841048 - DNA, 20 bp, mouse
gtggacagaaacagcagcgg

SEQ ID NO: 841049 - DNA, 20 bp, mouse
ggcatggccaatggcttaag

SEQ ID NO: 841050 - DNA, 20 bp, mouse
gggcaagggggggtgattgc

SEQ ID NO: 841051 - DNA, 20 bp, mouse
gcgggaaagggcatggccaa

SEQ ID NO: 841052 - DNA, 20 bp, mouse
gtcgcgctggagagcggggc

SEQ ID NO: 841053 - DNA, 20 bp, mouse
gtggagagcggggctggtgc

SEQ ID NO: 841054 - DNA, 20 bp, mouse
ggccccgccccttaagccat

SEQ ID NO: 841055 - DNA, 20 bp, mouse
gtcgcgggccgatgacgcac

SEQ ID NO: 841056 - DNA, 20 bp, mouse
ggggccccaagggattgtgt

SEQ ID NO: 841057 - DNA, 20 bp, mouse
ggatccgcccacagacctcc

SEQ ID NO: 841058 - DNA, 20 bp, mouse
gaccacccacacaatccctt

SEQ ID NO: 841059 - DNA, 20 bp, mouse
gcccctcccacgcccaagtg

SEQ ID NO: 841060 - DNA, 20 bp, mouse
gccccaagggattgtgtggg

SEQ ID NO: 841061 - DNA, 20 bp, mouse
ggatcctggaggtctgtggg

SEQ ID NO: 841062 - DNA, 20 bp, mouse
gcaggatcctggaggtctgt

SEQ ID NO: 841063 - DNA, 20 bp, mouse
gagaccgaggtgacctaaca

SEQ ID NO: 841064 - DNA, 20 bp, mouse
gcaggcgtacccgtttgtga

SEQ ID NO: 841065 - DNA, 20 bp, mouse
gcggatccgcacttgggcgt

SEQ ID NO: 841066 - DNA, 20 bp, mouse
gggctcgccagcaccggcac

SEQ ID NO: 841067 - DNA, 20 bp, mouse
ggggccaggtcggttttgaa

SEQ ID NO: 841068 - DNA, 20 bp, mouse
gagggcccggagaactccga

SEQ ID NO: 841069 - DNA, 20 bp, mouse
gaggggagaggcgggcgcag

SEQ ID NO: 841070 - DNA, 20 bp, mouse
ggtgtctgagagttgggcgc

SEQ ID NO: 841071 - DNA, 20 bp, mouse
ggcgcaggggctggccgctc

SEQ ID NO: 841072 - DNA, 20 bp, mouse
ggctgcgccaggccggaacg

SEQ ID NO: 841073 - DNA, 20 bp, mouse
gaactccgagggatcccagg

SEQ ID NO: 841074 - DNA, 20 bp, mouse
gctggccgctcgggccaggt

SEQ ID NO: 841075 - DNA, 20 bp, mouse
ggttagaccccgagcaaggg

SEQ ID NO: 841076 - DNA, 20 bp, mouse
ggagatgcgggccacagtca

SEQ ID NO: 841077 - DNA, 20 bp, mouse
gactgtggcccgcatctcgg

SEQ ID NO: 841078 - DNA, 20 bp, mouse
gggcgcgggccgctaatcag

SEQ ID NO: 841079 - DNA, 20 bp, mouse
ggcgcctggggtaggagcgc

SEQ ID NO: 841080 - DNA, 20 bp, mouse
gaaaactgaaagtgccgccc

SEQ ID NO: 841081 - DNA, 20 bp, mouse
gtctctgcgaggggtggagg

SEQ ID NO: 841082 - DNA, 20 bp, mouse
gtgaaagtgccgcccggggg

SEQ ID NO: 841083 - DNA, 20 bp, mouse
gcaggggcaggacaaattct

SEQ ID NO: 841084 - DNA, 20 bp, mouse
gaggctcccagctgcgtcct

SEQ ID NO: 841085 - DNA, 20 bp, mouse
gtagctgtcaggagcgaggg

SEQ ID NO: 841086 - DNA, 20 bp, mouse
gtataggtacacggcctcag

SEQ ID NO: 841087 - DNA, 20 bp, mouse
ggatatcacacatgctctat

SEQ ID NO: 841088 - DNA, 20 bp, mouse
ggagtccagataaacctctg

SEQ ID NO: 841089 - DNA, 20 bp, mouse
gaagagcagcagccctctgc

SEQ ID NO: 841090 - DNA, 20 bp, mouse
gcatgtgtgatatccagagg

SEQ ID NO: 841091 - DNA, 20 bp, mouse
gtagaggtttgaccagcaga

SEQ ID NO: 841092 - DNA, 20 bp, mouse
ggcggttctctgatatctat

SEQ ID NO: 841093 - DNA, 20 bp, mouse
gacggcctcagaggtttatc

SEQ ID NO: 841094 - DNA, 20 bp, mouse
ggatatcagagaaccgcctc

SEQ ID NO: 841095 - DNA, 20 bp, mouse
gatcaaaaggcgaccgaccg

SEQ ID NO: 841096 - DNA, 20 bp, mouse
ggccccgcccatcagccgtc

SEQ ID NO: 841097 - DNA, 20 bp, mouse
gcaggtggcagcagaccaga

SEQ ID NO: 841098 - DNA, 20 bp, mouse
gtggtctgctgccacctgtt

SEQ ID NO: 841099 - DNA, 20 bp, mouse
gagaccagacggctgatggg

SEQ ID NO: 841100 - DNA, 20 bp, mouse
ggcccggctccgcgagaggc

SEQ ID NO: 841101 - DNA, 20 bp, mouse
gtctgctgccacctgttggg

SEQ ID NO: 841102 - DNA, 20 bp, mouse
gtgccagccgctgtgccctg

SEQ ID NO: 841103 - DNA, 20 bp, mouse
gcagaggtaagccgcccaac

SEQ ID NO: 841104 - DNA, 20 bp, mouse
gaaccgcagggcacagcggc

SEQ ID NO: 841105 - DNA, 20 bp, mouse
gcccgggctgggcacgccct

SEQ ID NO: 841106 - DNA, 20 bp, mouse
gcacccacagcgtaggtata

SEQ ID NO: 841107 - DNA, 20 bp, mouse
gctagacacacccacagcgt

SEQ ID NO: 841108 - DNA, 20 bp, mouse
gtgcctgtgagaaacgtcac

SEQ ID NO: 841109 - DNA, 20 bp, mouse
gggcctgtgacgtttctcac

SEQ ID NO: 841110 - DNA, 20 bp, mouse
gcaactgaaagcatagttgt

SEQ ID NO: 841111 - DNA, 20 bp, mouse
gtgtgtgaatgacaacccag

SEQ ID NO: 841112 - DNA, 20 bp, mouse
gcttccttatacctacgctg

SEQ ID NO: 841113 - DNA, 20 bp, mouse
ggagggctcatagtggtaca

SEQ ID NO: 841114 - DNA, 20 bp, mouse
gtgtgctgatactggaataa

SEQ ID NO: 841115 - DNA, 20 bp, mouse
gagtgctaacacttcagatc

SEQ ID NO: 841116 - DNA, 20 bp, mouse
gcggcgccgcgaggcatgaa

SEQ ID NO: 841117 - DNA, 20 bp, mouse
ggggtccgaaattatgtcat

SEQ ID NO: 841118 - DNA, 20 bp, mouse
gtcaaggcggctttggaggc

SEQ ID NO: 841119 - DNA, 20 bp, mouse
gccgtggtgaagtatgtcta

SEQ ID NO: 841120 - DNA, 20 bp, mouse
gagcttcagtaccagaaaag

SEQ ID NO: 841121 - DNA, 20 bp, mouse
gatcccgccacgtcagtctg

SEQ ID NO: 841122 - DNA, 20 bp, mouse
gtaggagccaaataccctga

SEQ ID NO: 841123 - DNA, 20 bp, mouse
gggacgccgccggacgtccg

SEQ ID NO: 841124 - DNA, 20 bp, mouse
gcgagccccttcatgcctcg

SEQ ID NO: 841125 - DNA, 20 bp, mouse
gctcctctccggccgagcac

SEQ ID NO: 841126 - DNA, 20 bp, mouse
ggcgacacctactgaagcac

SEQ ID NO: 841127 - DNA, 20 bp, mouse
gaccaggaggccattcatct

SEQ ID NO: 841128 - DNA, 20 bp, mouse
gatgcggtgtggcacagcac

SEQ ID NO: 841129 - DNA, 20 bp, mouse
gcacacgcccacaaaaggag

SEQ ID NO: 841130 - DNA, 20 bp, mouse
gcttcagtaggtgtcgccag

SEQ ID NO: 841131 - DNA, 20 bp, mouse
gggcagagacactaattctg

SEQ ID NO: 841132 - DNA, 20 bp, mouse
gccagctgcttttctttcaa

SEQ ID NO: 841133 - DNA, 20 bp, mouse
gccctggattagttagtatc

SEQ ID NO: 841134 - DNA, 20 bp, mouse
gctttcaaaggatactcccc

SEQ ID NO: 841135 - DNA, 20 bp, mouse
gacacacacacgcccacaaa

SEQ ID NO: 841136 - DNA, 20 bp, mouse
ggtggggagcgtaaaatttt

SEQ ID NO: 841137 - DNA, 20 bp, mouse
gttgggctgggcttctgtta

SEQ ID NO: 841138 - DNA, 20 bp, mouse
gagggccgaagggcagacag

SEQ ID NO: 841139 - DNA, 20 bp, mouse
gctcaggagccaacctcctc

SEQ ID NO: 841140 - DNA, 20 bp, mouse
gcggggccgcacattcttct

SEQ ID NO: 841141 - DNA, 20 bp, mouse
gtgaggaaaggcagtttgtt

SEQ ID NO: 841142 - DNA, 20 bp, mouse
gagcggcaatgtcgcggtac

SEQ ID NO: 841143 - DNA, 20 bp, mouse
gaatccggataggagcgtcc

SEQ ID NO: 841144 - DNA, 20 bp, mouse
ggagagtcttctcacgtgac

SEQ ID NO: 841145 - DNA, 20 bp, mouse
gcccccaggacgctcctatc

SEQ ID NO: 841146 - DNA, 20 bp, mouse
gaccacgcccccaagaggtg

SEQ ID NO: 841147 - DNA, 20 bp, mouse
gaggtggggcggttttccag

SEQ ID NO: 841148 - DNA, 20 bp, mouse
gcagcgctaggacagtcccc

SEQ ID NO: 841149 - DNA, 20 bp, mouse
gcctagaccacgcccccaag

SEQ ID NO: 841150 - DNA, 20 bp, mouse
gtcggctactagtgcagcct

SEQ ID NO: 841151 - DNA, 20 bp, mouse
gaaaaccgccccacctcttg

SEQ ID NO: 841152 - DNA, 20 bp, mouse
gctgcactagtagccgactc

SEQ ID NO: 841153 - DNA, 20 bp, mouse
gctagcgctggcctcactcc

SEQ ID NO: 841154 - DNA, 20 bp, mouse
gtccgccaaggcgcctgggc

SEQ ID NO: 841155 - DNA, 20 bp, mouse
ggcctgcccaggcgccttgg

SEQ ID NO: 841156 - DNA, 20 bp, mouse
gaggaggacggaaaaatgta

SEQ ID NO: 841157 - DNA, 20 bp, mouse
ggggcgcgaccggaaggaat

SEQ ID NO: 841158 - DNA, 20 bp, mouse
gaccggaaggaatgggatcg

SEQ ID NO: 841159 - DNA, 20 bp, mouse
ggagggaccggaaaatgtgt

SEQ ID NO: 841160 - DNA, 20 bp, mouse
gggaaggaatgggatcgtgg

SEQ ID NO: 841161 - DNA, 20 bp, mouse
gagggctgaaggggcgcgac

SEQ ID NO: 841162 - DNA, 20 bp, mouse
gaggaatgggatcgtggagg

SEQ ID NO: 841163 - DNA, 20 bp, mouse
gaaatgtgtgggaccagtga

SEQ ID NO: 841164 - DNA, 20 bp, mouse
gccaagaggcgcaacacagc

SEQ ID NO: 841165 - DNA, 20 bp, mouse
gggaaaaatgtagggctgaa

SEQ ID NO: 841166 - DNA, 20 bp, mouse
gaggcgaggcaggtgatata

SEQ ID NO: 841167 - DNA, 20 bp, mouse
gagagctggggccatgcaat

SEQ ID NO: 841168 - DNA, 20 bp, mouse
gtctggaataatgaggtgtt

SEQ ID NO: 841169 - DNA, 20 bp, mouse
gaataggaagtcaacacact

SEQ ID NO: 841170 - DNA, 20 bp, mouse
gcaggaggaggattgacagg

SEQ ID NO: 841171 - DNA, 20 bp, mouse
gtctccaggaagcctcctca

SEQ ID NO: 841172 - DNA, 20 bp, mouse
gtgggctagacaataaaacc

SEQ ID NO: 841173 - DNA, 20 bp, mouse
gatcacctgcctcgcctccc

SEQ ID NO: 841174 - DNA, 20 bp, mouse
gagccatctgtgggagcaag

SEQ ID NO: 841175 - DNA, 20 bp, mouse
gtgaggtcaggaacctcccc

SEQ ID NO: 841176 - DNA, 20 bp, mouse
gagcacccgcgcagactcca

SEQ ID NO: 841177 - DNA, 20 bp, mouse
ggcagactccatgggctcga

SEQ ID NO: 841178 - DNA, 20 bp, mouse
gcgagggcgtggcccccaaa

SEQ ID NO: 841179 - DNA, 20 bp, mouse
ggggaagccggcattcgcgc

SEQ ID NO: 841180 - DNA, 20 bp, mouse
ggaccggtggaaggctgacg

SEQ ID NO: 841181 - DNA, 20 bp, mouse
ggcggggcatctctgaagtg

SEQ ID NO: 841182 - DNA, 20 bp, mouse
ggcgtggcccccaaagggcg

SEQ ID NO: 841183 - DNA, 20 bp, mouse
gacaagagaggcgggaccgg

SEQ ID NO: 841184 - DNA, 20 bp, mouse
gccaaagggcgtggcttcgc

SEQ ID NO: 841185 - DNA, 20 bp, mouse
gtcggagcctgcgcgaatgc

SEQ ID NO: 841186 - DNA, 20 bp, mouse
ggtgcctcgagggtccgctt

SEQ ID NO: 841187 - DNA, 20 bp, mouse
gaggtggcccgaattggtga

SEQ ID NO: 841188 - DNA, 20 bp, mouse
ggatgtgggcggtgcctcga

SEQ ID NO: 841189 - DNA, 20 bp, mouse
ggggctgaacggcgataagg

SEQ ID NO: 841190 - DNA, 20 bp, mouse
gccaagccctctgttgtgat

SEQ ID NO: 841191 - DNA, 20 bp, mouse
gcctggatatcaaggactta

SEQ ID NO: 841192 - DNA, 20 bp, mouse
gtgaaggaagtgatgttaga

SEQ ID NO: 841193 - DNA, 20 bp, mouse
gtggaatggagtaagtttaa

SEQ ID NO: 841194 - DNA, 20 bp, mouse
gcaattcgggccacctcatc

SEQ ID NO: 841195 - DNA, 20 bp, mouse
ggagggaggggctaggctag

SEQ ID NO: 841196 - DNA, 20 bp, mouse
gagcagcgaggagttctcat

SEQ ID NO: 841197 - DNA, 20 bp, mouse
gcgaccgcccgactccaaga

SEQ ID NO: 841198 - DNA, 20 bp, mouse
gcagacgccatcttggagtc

SEQ ID NO: 841199 - DNA, 20 bp, mouse
gccgccccagggagactacg

SEQ ID NO: 841200 - DNA, 20 bp, mouse
gcgtcggccaggagtcaaga

SEQ ID NO: 841201 - DNA, 20 bp, mouse
gggggaacaagtatcaaagt

SEQ ID NO: 841202 - DNA, 20 bp, mouse
gaacttgtgcacaatggagg

SEQ ID NO: 841203 - DNA, 20 bp, mouse
gaggcctgtgcgacctgtac

SEQ ID NO: 841204 - DNA, 20 bp, mouse
gcttccagtacaggtcgcac

SEQ ID NO: 841205 - DNA, 20 bp, mouse
gaagatggcgtctgcagcgt

SEQ ID NO: 841206 - DNA, 20 bp, mouse
ggcagcgtgggtgggaagag

SEQ ID NO: 841207 - DNA, 20 bp, mouse
gcaggggctggtccctacgg

SEQ ID NO: 841208 - DNA, 20 bp, mouse
ggctgggccaatcagcagcg

SEQ ID NO: 841209 - DNA, 20 bp, mouse
gaggaagtcttgcagttgct

SEQ ID NO: 841210 - DNA, 20 bp, mouse
gggccaatcagcagcgtggg

SEQ ID NO: 841211 - DNA, 20 bp, mouse
gtccgagtgaggcgcccgga

SEQ ID NO: 841212 - DNA, 20 bp, mouse
gcgtgggcggtgagcttctc

SEQ ID NO: 841213 - DNA, 20 bp, mouse
gcccctgaccgtccattggt

SEQ ID NO: 841214 - DNA, 20 bp, mouse
gcagccgcggccatcgcgcg

SEQ ID NO: 841215 - DNA, 20 bp, mouse
gggagcaggcggagcctcgg

SEQ ID NO: 841216 - DNA, 20 bp, mouse
gcaggcgtctagttgtctga

SEQ ID NO: 841217 - DNA, 20 bp, mouse
gccaaggcggggcccaagta

SEQ ID NO: 841218 - DNA, 20 bp, mouse
ggtggggaccagaccaggtc

SEQ ID NO: 841219 - DNA, 20 bp, mouse
gcgcctgttgccatgacgac

SEQ ID NO: 841220 - DNA, 20 bp, mouse
gccgcagcagagtggtgcta

SEQ ID NO: 841221 - DNA, 20 bp, mouse
gcggaagcgaggcctagcgt

SEQ ID NO: 841222 - DNA, 20 bp, mouse
gcgtggacaaggttccgggt

SEQ ID NO: 841223 - DNA, 20 bp, mouse
gaaggcgtggacaaggttcc

SEQ ID NO: 841224 - DNA, 20 bp, mouse
gcggccaccaagagatcgta

SEQ ID NO: 841225 - DNA, 20 bp, mouse
gcgccgcgcccaaaccaggt

SEQ ID NO: 841226 - DNA, 20 bp, mouse
ggggctttacaaggcagcaa

SEQ ID NO: 841227 - DNA, 20 bp, mouse
ggacaccaacaattgtgaaa

SEQ ID NO: 841228 - DNA, 20 bp, mouse
gggcttccccactcacagcg

SEQ ID NO: 841229 - DNA, 20 bp, mouse
ggaagcatcagtgtagatgt

SEQ ID NO: 841230 - DNA, 20 bp, mouse
gacaaatcctgaataggcta

SEQ ID NO: 841231 - DNA, 20 bp, mouse
gtctcttccacgctgtgagt

SEQ ID NO: 841232 - DNA, 20 bp, mouse
ggatataggcgtttcattta

SEQ ID NO: 841233 - DNA, 20 bp, mouse
gagaagggatattgttacac

SEQ ID NO: 841234 - DNA, 20 bp, mouse
gagtgcaggcccaagacagt

SEQ ID NO: 841235 - DNA, 20 bp, mouse
gtgacattgtgatgtcaatg

SEQ ID NO: 841236 - DNA, 20 bp, mouse
ggacctaagcgacctcttcc

SEQ ID NO: 841237 - DNA, 20 bp, mouse
gcagggcaggataacagagg

SEQ ID NO: 841238 - DNA, 20 bp, mouse
gaagaggtcgcttaggtcct

SEQ ID NO: 841239 - DNA, 20 bp, mouse
gcaccaggaagaggtcgctt

SEQ ID NO: 841240 - DNA, 20 bp, mouse
gtggcccttccttcaggccc

SEQ ID NO: 841241 - DNA, 20 bp, mouse
gtaacagaggaggtgctctt

SEQ ID NO: 841242 - DNA, 20 bp, mouse
gaaaacctggagctaagtta

SEQ ID NO: 841243 - DNA, 20 bp, mouse
ggcgctggaggtgctgcaca

SEQ ID NO: 841244 - DNA, 20 bp, mouse
ggccacgccccctgtcccgc

SEQ ID NO: 841245 - DNA, 20 bp, mouse
gaaccggactgagatagcgc

SEQ ID NO: 841246 - DNA, 20 bp, mouse
gccctgaaaacgggggtcgg

SEQ ID NO: 841247 - DNA, 20 bp, mouse
gggttgatgcagaagccaat

SEQ ID NO: 841248 - DNA, 20 bp, mouse
gagtccagaccctgaaaacg

SEQ ID NO: 841249 - DNA, 20 bp, mouse
ggacccccgttttcagggtc

SEQ ID NO: 841250 - DNA, 20 bp, mouse
gcacctggtcacagcataaa

SEQ ID NO: 841251 - DNA, 20 bp, mouse
gagaaaccatgcacattaag

SEQ ID NO: 841252 - DNA, 20 bp, mouse
ggcaagataagagagccgat

SEQ ID NO: 841253 - DNA, 20 bp, mouse
gtaggggcaggggagatgtt

SEQ ID NO: 841254 - DNA, 20 bp, mouse
gttcagagtcccaaagttct

SEQ ID NO: 841255 - DNA, 20 bp, mouse
gctgtgaccaggtgactagt

SEQ ID NO: 841256 - DNA, 20 bp, mouse
ggggctaatggccggaggga

SEQ ID NO: 841257 - DNA, 20 bp, mouse
gtgcctagcgcccatccctc

SEQ ID NO: 841258 - DNA, 20 bp, mouse
gccgagcctacgcttcacgt

SEQ ID NO: 841259 - DNA, 20 bp, mouse
gcacgtgggctaatggccgg

SEQ ID NO: 841260 - DNA, 20 bp, mouse
gtgcgggtcccggctctacc

SEQ ID NO: 841261 - DNA, 20 bp, mouse
gctccgccacccggaactac

SEQ ID NO: 841262 - DNA, 20 bp, mouse
gaggactgtagccaatgaag

SEQ ID NO: 841263 - DNA, 20 bp, mouse
ggatgggcgctaggcacgtt

SEQ ID NO: 841264 - DNA, 20 bp, mouse
gtacgcttcacgtgggctaa

SEQ ID NO: 841265 - DNA, 20 bp, mouse
gtcggctgggatcgagggag

SEQ ID NO: 841266 - DNA, 20 bp, mouse
gccgccggggcgcgtggaca

SEQ ID NO: 841267 - DNA, 20 bp, mouse
ggggaaaatggttgttgttc

SEQ ID NO: 841268 - DNA, 20 bp, mouse
gccccggcggcctcgctgat

SEQ ID NO: 841269 - DNA, 20 bp, mouse
gggacacggtgtgctcctag

SEQ ID NO: 841270 - DNA, 20 bp, mouse
ggaccctgaacctcatccag

SEQ ID NO: 841271 - DNA, 20 bp, mouse
gcggggtcccagcctcccgg

SEQ ID NO: 841272 - DNA, 20 bp, mouse
gtcccagcctcccgggggga

SEQ ID NO: 841273 - DNA, 20 bp, mouse
gcatccaggggactcctctt

SEQ ID NO: 841274 - DNA, 20 bp, mouse
ggtgctcctagcggggaaaa

SEQ ID NO: 841275 - DNA, 20 bp, mouse
gcaagggccaagtagccaat

SEQ ID NO: 841276 - DNA, 20 bp, mouse
ggcctgcgcctgcgcccttc

SEQ ID NO: 841277 - DNA, 20 bp, mouse
gcctcaggtgggcacgcaaa

SEQ ID NO: 841278 - DNA, 20 bp, mouse
gggcagtgagcgcctcaggt

SEQ ID NO: 841279 - DNA, 20 bp, mouse
ggtgggcacgcaaaaggaag

SEQ ID NO: 841280 - DNA, 20 bp, mouse
ggaggcgctcactgccggaa

SEQ ID NO: 841281 - DNA, 20 bp, mouse
ggccaccgcgcgggcgctga

SEQ ID NO: 841282 - DNA, 20 bp, mouse
gctcactgccggaagggcgc

SEQ ID NO: 841283 - DNA, 20 bp, mouse
ggaggcgagcgagaggggca

SEQ ID NO: 841284 - DNA, 20 bp, mouse
gcacccagcagccaccgcgc

SEQ ID NO: 841285 - DNA, 20 bp, mouse
ggagtcactcgacacgtcat

SEQ ID NO: 841286 - DNA, 20 bp, mouse
gtgcgcaggcccagctcgct

SEQ ID NO: 841287 - DNA, 20 bp, mouse
gagctcgacgcgctcaccga

SEQ ID NO: 841288 - DNA, 20 bp, mouse
gttacgaggtggggacgctt

SEQ ID NO: 841289 - DNA, 20 bp, mouse
ggctgggcggcgaccagggg

SEQ ID NO: 841290 - DNA, 20 bp, mouse
gatccccgccccctcggcag

SEQ ID NO: 841291 - DNA, 20 bp, mouse
gtgagcgcgagattagactc

SEQ ID NO: 841292 - DNA, 20 bp, mouse
gaggcaccgagtcgccaaga

SEQ ID NO: 841293 - DNA, 20 bp, mouse
gcctgcgcagagcgagccgt

SEQ ID NO: 841294 - DNA, 20 bp, mouse
ggtggggaccaagaggccga

SEQ ID NO: 841295 - DNA, 20 bp, mouse
ggtaacgcgtctagtgttgt

SEQ ID NO: 841296 - DNA, 20 bp, mouse
gctggctcgggggtgtgcaa

SEQ ID NO: 841297 - DNA, 20 bp, mouse
ggctcgggggtgtgcaaggg

SEQ ID NO: 841298 - DNA, 20 bp, mouse
gagggaggacaacacgagac

SEQ ID NO: 841299 - DNA, 20 bp, mouse
gaacaccccgcctctggctc

SEQ ID NO: 841300 - DNA, 20 bp, mouse
gtgcactggccgccagcgac

SEQ ID NO: 841301 - DNA, 20 bp, mouse
gcacacccccgagccagagg

SEQ ID NO: 841302 - DNA, 20 bp, mouse
ggctggcggccagtgcaaag

SEQ ID NO: 841303 - DNA, 20 bp, mouse
gcggccaccgctcgatccga

SEQ ID NO: 841304 - DNA, 20 bp, mouse
ggctcggaaggcctgttcgc

SEQ ID NO: 841305 - DNA, 20 bp, mouse
gtgttcgcggggttgcactc

SEQ ID NO: 841306 - DNA, 20 bp, mouse
gcagccccggcaacctgtcc

SEQ ID NO: 841307 - DNA, 20 bp, mouse
gccccccgacccaaaggccg

SEQ ID NO: 841308 - DNA, 20 bp, mouse
gcaaagtgagagctcctaat

SEQ ID NO: 841309 - DNA, 20 bp, mouse
ggagcagcgaggatgttgta

SEQ ID NO: 841310 - DNA, 20 bp, mouse
gcgcccgcctactaagagca

SEQ ID NO: 841311 - DNA, 20 bp, mouse
ggctgctattcaaagaatgt

SEQ ID NO: 841312 - DNA, 20 bp, mouse
ggaaccgccccccgacccaa

SEQ ID NO: 841313 - DNA, 20 bp, mouse
gcagccgcggcctttgggtc

SEQ ID NO: 841314 - DNA, 20 bp, mouse
gacaaccgggacaggttgcc

SEQ ID NO: 841315 - DNA, 20 bp, mouse
gacgccctgctcttagtagg

SEQ ID NO: 841316 - DNA, 20 bp, mouse
ggggtgaagggcccgtacgt

SEQ ID NO: 841317 - DNA, 20 bp, mouse
gggaatggggacacatgtga

SEQ ID NO: 841318 - DNA, 20 bp, mouse
ggaactgggactagggtgaa

SEQ ID NO: 841319 - DNA, 20 bp, mouse
gaatctgcatgcaccgaact

SEQ ID NO: 841320 - DNA, 20 bp, mouse
gagagcgcaagccggcgctg

SEQ ID NO: 841321 - DNA, 20 bp, mouse
gagggcccgtacgtgggaac

SEQ ID NO: 841322 - DNA, 20 bp, mouse
ggacgctcaggcagtgcgaa

SEQ ID NO: 841323 - DNA, 20 bp, mouse
gcgccggcttgcgctctcct

SEQ ID NO: 841324 - DNA, 20 bp, mouse
gaagccggcgctggggaatg

SEQ ID NO: 841325 - DNA, 20 bp, mouse
gcatgcaccgaactgggact

SEQ ID NO: 841326 - DNA, 20 bp, mouse
gaccgcgcgacccacggaga

SEQ ID NO: 841327 - DNA, 20 bp, mouse
gtggggcaaagttttcccgg

SEQ ID NO: 841328 - DNA, 20 bp, mouse
gagagggcccgcctaccgac

SEQ ID NO: 841329 - DNA, 20 bp, mouse
gaggtggggcaaagttttcc

SEQ ID NO: 841330 - DNA, 20 bp, mouse
gtagccctgtggaggcctgg

SEQ ID NO: 841331 - DNA, 20 bp, mouse
gggcgcaccggacagctacg

SEQ ID NO: 841332 - DNA, 20 bp, mouse
gggcgtggccggtcggtagg

SEQ ID NO: 841333 - DNA, 20 bp, mouse
ggtaggcgggccctctccgt

SEQ ID NO: 841334 - DNA, 20 bp, mouse
gtactctgtctaccacccag

SEQ ID NO: 841335 - DNA, 20 bp, mouse
gcccccgaccgcgcgaccca

SEQ ID NO: 841336 - DNA, 20 bp, mouse
gagggcggaaacgcagagga

SEQ ID NO: 841337 - DNA, 20 bp, mouse
ggtggcaagcggaactgagg

SEQ ID NO: 841338 - DNA, 20 bp, mouse
gggtgagggcggaaacgcag

SEQ ID NO: 841339 - DNA, 20 bp, mouse
gtggacgtcgaaggtgaggg

SEQ ID NO: 841340 - DNA, 20 bp, mouse
gagggccgggcggaaaagtg

SEQ ID NO: 841341 - DNA, 20 bp, mouse
gtgcccgtcggcctacacca

SEQ ID NO: 841342 - DNA, 20 bp, mouse
gcctacgcgccacttgccat

SEQ ID NO: 841343 - DNA, 20 bp, mouse
ggattggacgtcgaaggtga

SEQ ID NO: 841344 - DNA, 20 bp, mouse
gcttcgacgtccaatcgtag

SEQ ID NO: 841345 - DNA, 20 bp, mouse
ggctccccgaggcagtgggg

SEQ ID NO: 841346 - DNA, 20 bp, mouse
gaactgggcagagcgaactc

SEQ ID NO: 841347 - DNA, 20 bp, mouse
gggcagagcgaactccggtc

SEQ ID NO: 841348 - DNA, 20 bp, mouse
gaccaagaccccagggaact

SEQ ID NO: 841349 - DNA, 20 bp, mouse
gaggcaagcgacagatctct

SEQ ID NO: 841350 - DNA, 20 bp, mouse
gctggggtcttggtatctat

SEQ ID NO: 841351 - DNA, 20 bp, mouse
ggctgtaacccgacccttaa

SEQ ID NO: 841352 - DNA, 20 bp, mouse
gtctccgaagcgggcaagga

SEQ ID NO: 841353 - DNA, 20 bp, mouse
ggggttacagcgctccggac

SEQ ID NO: 841354 - DNA, 20 bp, mouse
ggggtcgggttacagcgctc

SEQ ID NO: 841355 - DNA, 20 bp, mouse
ggccaggacctttaagggtc

SEQ ID NO: 841356 - DNA, 20 bp, mouse
gggctcttaatgccataata

SEQ ID NO: 841357 - DNA, 20 bp, mouse
gctagccgactcaatctccc

SEQ ID NO: 841358 - DNA, 20 bp, mouse
gcgcccccacgtgacagaag

SEQ ID NO: 841359 - DNA, 20 bp, mouse
gttccggccgccagaatccg

SEQ ID NO: 841360 - DNA, 20 bp, mouse
gccccacaccctgatcctat

SEQ ID NO: 841361 - DNA, 20 bp, mouse
gcggggtctgccacggattc

SEQ ID NO: 841362 - DNA, 20 bp, mouse
gttaagagcctataggatca

SEQ ID NO: 841363 - DNA, 20 bp, mouse
ggtaaccacttctgtcacgt

SEQ ID NO: 841364 - DNA, 20 bp, mouse
ggcctataggatcagggtgt

SEQ ID NO: 841365 - DNA, 20 bp, mouse
ggggtctcaagtacctaggc

SEQ ID NO: 841366 - DNA, 20 bp, mouse
gtaaaagcttagtgtaaaac

SEQ ID NO: 841367 - DNA, 20 bp, mouse
gagtgaggtaactaaattga

SEQ ID NO: 841368 - DNA, 20 bp, mouse
gttgtacatagcccatagtg

SEQ ID NO: 841369 - DNA, 20 bp, mouse
gagaaggggagtggttatat

SEQ ID NO: 841370 - DNA, 20 bp, mouse
gcatgtgatagtcactccag

SEQ ID NO: 841371 - DNA, 20 bp, mouse
gtatgatctctaaatacaac

SEQ ID NO: 841372 - DNA, 20 bp, mouse
gtaacaaagtaagatatctt

SEQ ID NO: 841373 - DNA, 20 bp, mouse
gcatcatctcttatgaataa

SEQ ID NO: 841374 - DNA, 20 bp, mouse
gagagtatttgatgtaagaa

SEQ ID NO: 841375 - DNA, 20 bp, mouse
gcacatgactaactttttct

SEQ ID NO: 841376 - DNA, 20 bp, mouse
gccgctgcgccttctggagg

SEQ ID NO: 841377 - DNA, 20 bp, mouse
gcagcagcgaggagtccccg

SEQ ID NO: 841378 - DNA, 20 bp, mouse
ggcgggaggtcgggcggtaa

SEQ ID NO: 841379 - DNA, 20 bp, mouse
ggtcccgctgcgccttctgg

SEQ ID NO: 841380 - DNA, 20 bp, mouse
gagcggcagcggagtggcca

SEQ ID NO: 841381 - DNA, 20 bp, mouse
ggcttccaagaggggttctg

SEQ ID NO: 841382 - DNA, 20 bp, mouse
gagtccccggggctgcggct

SEQ ID NO: 841383 - DNA, 20 bp, mouse
gaagggctgaggttagcgct

SEQ ID NO: 841384 - DNA, 20 bp, mouse
gtggcaggagcttccaagag

SEQ ID NO: 841385 - DNA, 20 bp, mouse
gcggcggcggcggctgtgga

SEQ ID NO: 841386 - DNA, 20 bp, mouse
ggctgtgccacggtcccaat

SEQ ID NO: 841387 - DNA, 20 bp, mouse
ggaaggaggaagtgtgaggt

SEQ ID NO: 841388 - DNA, 20 bp, mouse
ggaggaggaacgtatagaca

SEQ ID NO: 841389 - DNA, 20 bp, mouse
gttggaacaggagggactgt

SEQ ID NO: 841390 - DNA, 20 bp, mouse
gagagggcaaatcttggaac

SEQ ID NO: 841391 - DNA, 20 bp, mouse
gctgctctagtaatgctggt

SEQ ID NO: 841392 - DNA, 20 bp, mouse
ggcctgtgaccatgatggga

SEQ ID NO: 841393 - DNA, 20 bp, mouse
gacgtccaaccaagtgaagg

SEQ ID NO: 841394 - DNA, 20 bp, mouse
ggatacttacaaggctaatg

SEQ ID NO: 841395 - DNA, 20 bp, mouse
gagctcagggggctgtgcca

SEQ ID NO: 841396 - DNA, 20 bp, mouse
gcctcccagtgtgaggaatc

SEQ ID NO: 841397 - DNA, 20 bp, mouse
ggtgctgcctagtagttaaa

SEQ ID NO: 841398 - DNA, 20 bp, mouse
gagtgtgaggaatctggctt

SEQ ID NO: 841399 - DNA, 20 bp, mouse
gtggcttgggatttactgtc

SEQ ID NO: 841400 - DNA, 20 bp, mouse
gctcctgccctttaactact

SEQ ID NO: 841401 - DNA, 20 bp, mouse
gtcttcgggcaattaacagc

SEQ ID NO: 841402 - DNA, 20 bp, mouse
gcaggcttacatttgaatgt

SEQ ID NO: 841403 - DNA, 20 bp, mouse
gccatcacaaggaaaccagt

SEQ ID NO: 841404 - DNA, 20 bp, mouse
gtgctttcttggtcgaacta

SEQ ID NO: 841405 - DNA, 20 bp, mouse
ggaaaatacaagtgtgacat

SEQ ID NO: 841406 - DNA, 20 bp, mouse
gcccaaacccaaggattcct

SEQ ID NO: 841407 - DNA, 20 bp, mouse
gcaagtacgagattcgactg

SEQ ID NO: 841408 - DNA, 20 bp, mouse
gagccagcctaggaatcctt

SEQ ID NO: 841409 - DNA, 20 bp, mouse
gttaagagggcggggaaagg

SEQ ID NO: 841410 - DNA, 20 bp, mouse
gtggctaaattaagagggcg

SEQ ID NO: 841411 - DNA, 20 bp, mouse
ggtcacagggaaaccgacaa

SEQ ID NO: 841412 - DNA, 20 bp, mouse
gctaggctggctaaattaag

SEQ ID NO: 841413 - DNA, 20 bp, mouse
gtgtgcccaaccaataagag

SEQ ID NO: 841414 - DNA, 20 bp, mouse
ggtagggtacagttagatgc

SEQ ID NO: 841415 - DNA, 20 bp, mouse
gcacagcgccgagtcctgat

SEQ ID NO: 841416 - DNA, 20 bp, mouse
gtgggaaacgcggtccagag

SEQ ID NO: 841417 - DNA, 20 bp, mouse
gggcgggcctgtgggaaacg

SEQ ID NO: 841418 - DNA, 20 bp, mouse
gtggaaaggggcgggcctgt

SEQ ID NO: 841419 - DNA, 20 bp, mouse
gccgaagcgagaaataacag

SEQ ID NO: 841420 - DNA, 20 bp, mouse
gcgagaaataacagtggagc

SEQ ID NO: 841421 - DNA, 20 bp, mouse
gtctcgcttcggctcagaag

SEQ ID NO: 841422 - DNA, 20 bp, mouse
ggagccaatccgagaagtac

SEQ ID NO: 841423 - DNA, 20 bp, mouse
gcttcctgtacttctcggat

SEQ ID NO: 841424 - DNA, 20 bp, mouse
gataggctcaaatagaaaag

SEQ ID NO: 841425 - DNA, 20 bp, mouse
gttcccaggtttagaagtga

SEQ ID NO: 841426 - DNA, 20 bp, mouse
ggctcttccggaacctacca

SEQ ID NO: 841427 - DNA, 20 bp, mouse
gcgtgcggtagcttcttccc

SEQ ID NO: 841428 - DNA, 20 bp, mouse
gcgaggggacgccaagtgct

SEQ ID NO: 841429 - DNA, 20 bp, mouse
gttaacgcccaaggagtgcg

SEQ ID NO: 841430 - DNA, 20 bp, mouse
gaaggagtgcgcggctcttc

SEQ ID NO: 841431 - DNA, 20 bp, mouse
gacttgacgcatgtgcagta

SEQ ID NO: 841432 - DNA, 20 bp, mouse
gcgcgaacccttaacgccca

SEQ ID NO: 841433 - DNA, 20 bp, mouse
gcggtagcttcttccctggt

SEQ ID NO: 841434 - DNA, 20 bp, mouse
gcacagatctcgagctcgag

SEQ ID NO: 841435 - DNA, 20 bp, mouse
ggaccaatgtggccgtggtg

SEQ ID NO: 841436 - DNA, 20 bp, mouse
gggggagcctagcgaagtta

SEQ ID NO: 841437 - DNA, 20 bp, mouse
gcgtacaggcgtaaaccgag

SEQ ID NO: 841438 - DNA, 20 bp, mouse
gaagctccagaaggtctgtg

SEQ ID NO: 841439 - DNA, 20 bp, mouse
gacaggcgtaaaccgagagg

SEQ ID NO: 841440 - DNA, 20 bp, mouse
gagaccttctggagcttagg

SEQ ID NO: 841441 - DNA, 20 bp, mouse
ggtgcgccgccagaccgtac

SEQ ID NO: 841442 - DNA, 20 bp, mouse
gtcacccaggaccgcaagca

SEQ ID NO: 841443 - DNA, 20 bp, mouse
ggcggccggtggttccgact

SEQ ID NO: 841444 - DNA, 20 bp, mouse
gaaacctcctaagctccaga

SEQ ID NO: 841445 - DNA, 20 bp, mouse
ggaggaccaaagttccccat

SEQ ID NO: 841446 - DNA, 20 bp, mouse
gttctctgaaggggcgaagc

SEQ ID NO: 841447 - DNA, 20 bp, mouse
gcgaggcagagaggtcagtt

SEQ ID NO: 841448 - DNA, 20 bp, mouse
gtctaggtcactaccatcgt

SEQ ID NO: 841449 - DNA, 20 bp, mouse
gcggaaacgctgaatgcacg

SEQ ID NO: 841450 - DNA, 20 bp, mouse
ggacccgtggtatccaacga

SEQ ID NO: 841451 - DNA, 20 bp, mouse
gtcgcaatgaagaaacttca

SEQ ID NO: 841452 - DNA, 20 bp, mouse
gtgtgttcgcatggtcgtca

SEQ ID NO: 841453 - DNA, 20 bp, mouse
gtaccatcgttggataccac

SEQ ID NO: 841454 - DNA, 20 bp, mouse
gatggctaaacacttgatca

SEQ ID NO: 841455 - DNA, 20 bp, mouse
ggtatcgctgagttctctga

SEQ ID NO: 841456 - DNA, 20 bp, mouse
gcggcgggagcgggaaacag

SEQ ID NO: 841457 - DNA, 20 bp, mouse
ggggtcccgcgcattgcttg

SEQ ID NO: 841458 - DNA, 20 bp, mouse
gtgcgcaggcgccagggtag

SEQ ID NO: 841459 - DNA, 20 bp, mouse
gtaagccgcaagcaatgcgc

SEQ ID NO: 841460 - DNA, 20 bp, mouse
ggggcgggacgaagagcatg

SEQ ID NO: 841461 - DNA, 20 bp, mouse
ggggacccgcccgggcgcca

SEQ ID NO: 841462 - DNA, 20 bp, mouse
gcgggcgccaaggagtgcgc

SEQ ID NO: 841463 - DNA, 20 bp, mouse
ggcaatgcgcgggacccgcc

SEQ ID NO: 841464 - DNA, 20 bp, mouse
ggctgcggggtcatcttggt

SEQ ID NO: 841465 - DNA, 20 bp, mouse
gctggcgcctgcgcactcct

SEQ ID NO: 841466 - DNA, 20 bp, mouse
ggcgtacaacgtagcggagg

SEQ ID NO: 841467 - DNA, 20 bp, mouse
gcatgcgtacaacgtagcgg

SEQ ID NO: 841468 - DNA, 20 bp, mouse
gtacctcggaacaggctcgt

SEQ ID NO: 841469 - DNA, 20 bp, mouse
ggtcaagcgcgtgtttttct

SEQ ID NO: 841470 - DNA, 20 bp, mouse
gcgcgcttgacggtcgagga

SEQ ID NO: 841471 - DNA, 20 bp, mouse
ggtgaagggagtagcctctc

SEQ ID NO: 841472 - DNA, 20 bp, mouse
gacgcaaggagcaggcgcgt

SEQ ID NO: 841473 - DNA, 20 bp, mouse
gtacaacgtagcggaggggg

SEQ ID NO: 841474 - DNA, 20 bp, mouse
ggtccagtcccggggaagaa

SEQ ID NO: 841475 - DNA, 20 bp, mouse
ggactctcaactcaccagtg

SEQ ID NO: 841476 - DNA, 20 bp, mouse
gaaggggcggagtgaccctg

SEQ ID NO: 841477 - DNA, 20 bp, mouse
gccgtccgagaacagccgac

SEQ ID NO: 841478 - DNA, 20 bp, mouse
gcgagctcggggaagttccg

SEQ ID NO: 841479 - DNA, 20 bp, mouse
ggagaacagccgacaggctt

SEQ ID NO: 841480 - DNA, 20 bp, mouse
gggacggagcagtcggaagg

SEQ ID NO: 841481 - DNA, 20 bp, mouse
gcggagcagtcggaaggcgg

SEQ ID NO: 841482 - DNA, 20 bp, mouse
gggaagggaccgatattctc

SEQ ID NO: 841483 - DNA, 20 bp, mouse
ggctcggggaagttccgggg

SEQ ID NO: 841484 - DNA, 20 bp, mouse
gctcggacggagcagtcgga

SEQ ID NO: 841485 - DNA, 20 bp, mouse
gcgccccttccggagaatat

SEQ ID NO: 841486 - DNA, 20 bp, mouse
ggcagccgagcgcgccagaa

SEQ ID NO: 841487 - DNA, 20 bp, mouse
gactgggcgccgcaattcac

SEQ ID NO: 841488 - DNA, 20 bp, mouse
gaccggaaggcgagcggggt

SEQ ID NO: 841489 - DNA, 20 bp, mouse
gggcgccgcaattcaccgga

SEQ ID NO: 841490 - DNA, 20 bp, mouse
gctcgccttccggtgaattg

SEQ ID NO: 841491 - DNA, 20 bp, mouse
ggccgagacggagacctccg

SEQ ID NO: 841492 - DNA, 20 bp, mouse
gcacgcgcctgcggaattta

SEQ ID NO: 841493 - DNA, 20 bp, mouse
ggaaggcgagcggggtgggc

SEQ ID NO: 841494 - DNA, 20 bp, mouse
gcctcgacgcggaagtcacg

SEQ ID NO: 841495 - DNA, 20 bp, mouse
ggccgcggaggtctccgtct

SEQ ID NO: 841496 - DNA, 20 bp, mouse
gccccacctcattccttaag

SEQ ID NO: 841497 - DNA, 20 bp, mouse
gagccccttaaggaatgagg

SEQ ID NO: 841498 - DNA, 20 bp, mouse
ggggacccccccaacacctg

SEQ ID NO: 841499 - DNA, 20 bp, mouse
gacaggggagcctttgtgca

SEQ ID NO: 841500 - DNA, 20 bp, mouse
ggtacaggctgcatccgtat

SEQ ID NO: 841501 - DNA, 20 bp, mouse
gacccagggcaaagcccata

SEQ ID NO: 841502 - DNA, 20 bp, mouse
gctaggctctagctgaattc

SEQ ID NO: 841503 - DNA, 20 bp, mouse
ggactctggaggtctttgta

SEQ ID NO: 841504 - DNA, 20 bp, mouse
gtgcatgagtagttcagaca

SEQ ID NO: 841505 - DNA, 20 bp, mouse
ggccctgggtctcactgggc

SEQ ID NO: 841506 - DNA, 20 bp, mouse
gtcgctcaaccgggtccctc

SEQ ID NO: 841507 - DNA, 20 bp, mouse
gcccgtctcctggctggggt

SEQ ID NO: 841508 - DNA, 20 bp, mouse
gccccttcccggtttccgat

SEQ ID NO: 841509 - DNA, 20 bp, mouse
gtaagccgggacccgatagg

SEQ ID NO: 841510 - DNA, 20 bp, mouse
gaccaatcggaaaccgggaa

SEQ ID NO: 841511 - DNA, 20 bp, mouse
gggcccgattggctgccgga

SEQ ID NO: 841512 - DNA, 20 bp, mouse
gctcgcgaatgggaagaaga

SEQ ID NO: 841513 - DNA, 20 bp, mouse
gagcctggggagataagaac

SEQ ID NO: 841514 - DNA, 20 bp, mouse
gacacacatggggatctctg

SEQ ID NO: 841515 - DNA, 20 bp, mouse
gccctctggaggaaaagttg

SEQ ID NO: 841516 - DNA, 20 bp, mouse
gagtggctgcggcccagggg

SEQ ID NO: 841517 - DNA, 20 bp, mouse
gcgaccgagaacagccaaag

SEQ ID NO: 841518 - DNA, 20 bp, mouse
ggtgagtggctgcggcccag

SEQ ID NO: 841519 - DNA, 20 bp, mouse
gggcaccggcgacaggaagg

SEQ ID NO: 841520 - DNA, 20 bp, mouse
gcccctcccgccgcggtgag

SEQ ID NO: 841521 - DNA, 20 bp, mouse
gccgccgcggtgagtggctg

SEQ ID NO: 841522 - DNA, 20 bp, mouse
ggggtcctctcggtcacccg

SEQ ID NO: 841523 - DNA, 20 bp, mouse
gctgcggcccaggggcggag

SEQ ID NO: 841524 - DNA, 20 bp, mouse
ggggcggagcggaagcctgc

SEQ ID NO: 841525 - DNA, 20 bp, mouse
gggctcctccttcctgtcgc

SEQ ID NO: 841526 - DNA, 20 bp, mouse
gcccgcccctttttcctctt

SEQ ID NO: 841527 - DNA, 20 bp, mouse
ggcagcccaagaggaaaaag

SEQ ID NO: 841528 - DNA, 20 bp, mouse
gcaagtccggaaacgcgcag

SEQ ID NO: 841529 - DNA, 20 bp, mouse
gaccctgggcccgcccccct

SEQ ID NO: 841530 - DNA, 20 bp, mouse
ggtactaggaaggcctgctc

SEQ ID NO: 841531 - DNA, 20 bp, mouse
gcgggggctgagatcccagg

SEQ ID NO: 841532 - DNA, 20 bp, mouse
gtgtcacgagaccaggccgg

SEQ ID NO: 841533 - DNA, 20 bp, mouse
gtgctgggaggccagatcct

SEQ ID NO: 841534 - DNA, 20 bp, mouse
gtctggcctcccagcattca

SEQ ID NO: 841535 - DNA, 20 bp, mouse
ggtcagaaagtcacgagtac

SEQ ID NO: 841536 - DNA, 20 bp, mouse
gaatcacgaagcaaggttat

SEQ ID NO: 841537 - DNA, 20 bp, mouse
ggaaaaacaggtagagcaag

SEQ ID NO: 841538 - DNA, 20 bp, mouse
gctgtcaaagaaatcaagga

SEQ ID NO: 841539 - DNA, 20 bp, mouse
gacccagtaagcaagaaaca

SEQ ID NO: 841540 - DNA, 20 bp, mouse
gcagtgagatggaacaaaag

SEQ ID NO: 841541 - DNA, 20 bp, mouse
gaaaatacatgattcatgag

SEQ ID NO: 841542 - DNA, 20 bp, mouse
ggattcacgatcgggaagaa

SEQ ID NO: 841543 - DNA, 20 bp, mouse
gttgcagtagctgggaatca

SEQ ID NO: 841544 - DNA, 20 bp, mouse
gttgcttcgtgattcacgat

SEQ ID NO: 841545 - DNA, 20 bp, mouse
gaagaagtcccaaactgggc

SEQ ID NO: 841546 - DNA, 20 bp, mouse
gccaatgcgcgatgcatgct

SEQ ID NO: 841547 - DNA, 20 bp, mouse
ggggaaggttggaactccga

SEQ ID NO: 841548 - DNA, 20 bp, mouse
gttctgtgagggtggaaaaa

SEQ ID NO: 841549 - DNA, 20 bp, mouse
gcacgtgcaccaggcattag

SEQ ID NO: 841550 - DNA, 20 bp, mouse
ggaagcgcgggggccttaga

SEQ ID NO: 841551 - DNA, 20 bp, mouse
gcgcctctggcccgggtttc

SEQ ID NO: 841552 - DNA, 20 bp, mouse
gagggacaaaaatcccatac

SEQ ID NO: 841553 - DNA, 20 bp, mouse
gccctctattcaggcgtcta

SEQ ID NO: 841554 - DNA, 20 bp, mouse
gccttagagggccgggtctg

SEQ ID NO: 841555 - DNA, 20 bp, mouse
gcaccaggcattagcgggac

SEQ ID NO: 841556 - DNA, 20 bp, mouse
ggcgctggcccagtcggaag

SEQ ID NO: 841557 - DNA, 20 bp, mouse
gttagctggggtctctggta

SEQ ID NO: 841558 - DNA, 20 bp, mouse
gggcccagtcggaagcggaa

SEQ ID NO: 841559 - DNA, 20 bp, mouse
gttgggagcctcagttctct

SEQ ID NO: 841560 - DNA, 20 bp, mouse
gccagtcggaagcggaaggg

SEQ ID NO: 841561 - DNA, 20 bp, mouse
gagcgctttaatgctctgtt

SEQ ID NO: 841562 - DNA, 20 bp, mouse
gaagatggcgctggcccagt

SEQ ID NO: 841563 - DNA, 20 bp, mouse
ggaatgaatatgcaagagga

SEQ ID NO: 841564 - DNA, 20 bp, mouse
ggcaggaatgaatatgcaag

SEQ ID NO: 841565 - DNA, 20 bp, mouse
gagctggtcgggcaatctgc

SEQ ID NO: 841566 - DNA, 20 bp, mouse
gtctcagcctgagatgccta

SEQ ID NO: 841567 - DNA, 20 bp, mouse
gaggcgacaccctgagtcct

SEQ ID NO: 841568 - DNA, 20 bp, mouse
gcgccatcccgccccgggat

SEQ ID NO: 841569 - DNA, 20 bp, mouse
gacttctcacacaattccag

SEQ ID NO: 841570 - DNA, 20 bp, mouse
ggaagtggtggcacacgagg

SEQ ID NO: 841571 - DNA, 20 bp, mouse
gtgtcgcctgagcccatccc

SEQ ID NO: 841572 - DNA, 20 bp, mouse
gcccgccccgggatgggctc

SEQ ID NO: 841573 - DNA, 20 bp, mouse
gtgacccggccgggaagtgg

SEQ ID NO: 841574 - DNA, 20 bp, mouse
gcggccgcactgcgcaggag

SEQ ID NO: 841575 - DNA, 20 bp, mouse
ggaagtaatcccaggactca

SEQ ID NO: 841576 - DNA, 20 bp, mouse
gactagaggcgcggcttcag

SEQ ID NO: 841577 - DNA, 20 bp, mouse
gagaggcggagctggggttt

SEQ ID NO: 841578 - DNA, 20 bp, mouse
gaaacggagaggcggagctg

SEQ ID NO: 841579 - DNA, 20 bp, mouse
gaaggcggagccagtactag

SEQ ID NO: 841580 - DNA, 20 bp, mouse
gctattagaaggaggagcga

SEQ ID NO: 841581 - DNA, 20 bp, mouse
gtaggagggaaaaactgagc

SEQ ID NO: 841582 - DNA, 20 bp, mouse
ggggttccgaggctttagga

SEQ ID NO: 841583 - DNA, 20 bp, mouse
ggcggcttcaggggacgaga

SEQ ID NO: 841584 - DNA, 20 bp, mouse
ggggactgcaggtgaatgga

SEQ ID NO: 841585 - DNA, 20 bp, mouse
ggggaaagctagttgaacag

SEQ ID NO: 841586 - DNA, 20 bp, mouse
gcgccagcggaagacctgtg

SEQ ID NO: 841587 - DNA, 20 bp, mouse
gggcacgccggaagcccggt

SEQ ID NO: 841588 - DNA, 20 bp, mouse
gtcccagtaagacacgtctc

SEQ ID NO: 841589 - DNA, 20 bp, mouse
gctggcgcgtccttagtcta

SEQ ID NO: 841590 - DNA, 20 bp, mouse
gggcggcggcgcaccggaag

SEQ ID NO: 841591 - DNA, 20 bp, mouse
gaatggccgtcgacttgatc

SEQ ID NO: 841592 - DNA, 20 bp, mouse
ggagtctgggactcggagtc

SEQ ID NO: 841593 - DNA, 20 bp, mouse
gactccagctctgacgctga

SEQ ID NO: 841594 - DNA, 20 bp, mouse
gtgtgtccagatcaagtcga

SEQ ID NO: 841595 - DNA, 20 bp, mouse
gttctctagaaccaagaccc

SEQ ID NO: 841596 - DNA, 20 bp, mouse
gcccggggcgggacgacatg

SEQ ID NO: 841597 - DNA, 20 bp, mouse
ggcttcgccgggcgccatgt

SEQ ID NO: 841598 - DNA, 20 bp, mouse
ggtcccgccccgggcttcgc

SEQ ID NO: 841599 - DNA, 20 bp, mouse
gatggcgcccggcgaagccc

SEQ ID NO: 841600 - DNA, 20 bp, mouse
gcgagaatagtcgttctgtc

SEQ ID NO: 841601 - DNA, 20 bp, mouse
gggcgggacgacatgcggcg

SEQ ID NO: 841602 - DNA, 20 bp, mouse
ggcccgcgctacctaccagt

SEQ ID NO: 841603 - DNA, 20 bp, mouse
gtctgtctggagccgcttcc

SEQ ID NO: 841604 - DNA, 20 bp, mouse
gactctgaaccccagccgac

SEQ ID NO: 841605 - DNA, 20 bp, mouse
ggttaagctccacccggaag

SEQ ID NO: 841606 - DNA, 20 bp, mouse
gcggaagtcaggtgtcccag

SEQ ID NO: 841607 - DNA, 20 bp, mouse
ggaggggagtgcctacgtga

SEQ ID NO: 841608 - DNA, 20 bp, mouse
gacggggcgcgcttccttgc

SEQ ID NO: 841609 - DNA, 20 bp, mouse
gggacacctgacttccggtt

SEQ ID NO: 841610 - DNA, 20 bp, mouse
gaaccaaaacgcgtcacttc

SEQ ID NO: 841611 - DNA, 20 bp, mouse
ggggcggcgacgtcaccagg

SEQ ID NO: 841612 - DNA, 20 bp, mouse
ggaaaagtacgcccaggaca

SEQ ID NO: 841613 - DNA, 20 bp, mouse
gtgagcgctgagggcaaacg

SEQ ID NO: 841614 - DNA, 20 bp, mouse
gtgagagcgtaccgctccag

SEQ ID NO: 841615 - DNA, 20 bp, mouse
ggcggggccgcgagggtcaa

SEQ ID NO: 841616 - DNA, 20 bp, mouse
ggtctgactcagagagtcac

SEQ ID NO: 841617 - DNA, 20 bp, mouse
gcctgagcttctcatttctc

SEQ ID NO: 841618 - DNA, 20 bp, mouse
gccaactggggtttatcgct

SEQ ID NO: 841619 - DNA, 20 bp, mouse
ggtgctctgcaggccaactg

SEQ ID NO: 841620 - DNA, 20 bp, mouse
gcactggcctcttgtaacac

SEQ ID NO: 841621 - DNA, 20 bp, mouse
gtaagtcccagtgttacaag

SEQ ID NO: 841622 - DNA, 20 bp, mouse
gggaggaacagggactcatg

SEQ ID NO: 841623 - DNA, 20 bp, mouse
gctggtcctcccagtgaatg

SEQ ID NO: 841624 - DNA, 20 bp, mouse
gatgggcgagaggttattta

SEQ ID NO: 841625 - DNA, 20 bp, mouse
ggatatctgtcctcattcac

SEQ ID NO: 841626 - DNA, 20 bp, mouse
ggagctatggggccctgtat

SEQ ID NO: 841627 - DNA, 20 bp, mouse
gagactggggctgcttcctg

SEQ ID NO: 841628 - DNA, 20 bp, mouse
gcgcacaggccagctggaga

SEQ ID NO: 841629 - DNA, 20 bp, mouse
gggggcggaaggtgggatct

SEQ ID NO: 841630 - DNA, 20 bp, mouse
ggaagctggagctgcgtcgc

SEQ ID NO: 841631 - DNA, 20 bp, mouse
gacgcagctccagcttcctc

SEQ ID NO: 841632 - DNA, 20 bp, mouse
gcccaggctggggccagcac

SEQ ID NO: 841633 - DNA, 20 bp, mouse
gagggcttcagactgctcgc

SEQ ID NO: 841634 - DNA, 20 bp, mouse
gcagctggagagggggagac

SEQ ID NO: 841635 - DNA, 20 bp, mouse
gagctgcggccaaggggtgg

SEQ ID NO: 841636 - DNA, 20 bp, mouse
gcccgcaccgcgccggaaat

SEQ ID NO: 841637 - DNA, 20 bp, mouse
gccgccgcccgtcactgaag

SEQ ID NO: 841638 - DNA, 20 bp, mouse
ggggaggtgctgaaggaatg

SEQ ID NO: 841639 - DNA, 20 bp, mouse
gccccccgcccgcaccgcgc

SEQ ID NO: 841640 - DNA, 20 bp, mouse
gttccggcgcggtgcgggcg

SEQ ID NO: 841641 - DNA, 20 bp, mouse
gccgccgtgcgctccttcgc

SEQ ID NO: 841642 - DNA, 20 bp, mouse
gtgcgaccgcgcgctccggg

SEQ ID NO: 841643 - DNA, 20 bp, mouse
ggctacggcgacacgggcag

SEQ ID NO: 841644 - DNA, 20 bp, mouse
ggccgggagttgtcgttccc

SEQ ID NO: 841645 - DNA, 20 bp, mouse
gcggctgcgaccgcgcgctc

SEQ ID NO: 841646 - DNA, 20 bp, mouse
gtcgcccagtgaaaggtcag

SEQ ID NO: 841647 - DNA, 20 bp, mouse
gcacctacgcacttcctctc

SEQ ID NO: 841648 - DNA, 20 bp, mouse
ggcttccggtagttcggggc

SEQ ID NO: 841649 - DNA, 20 bp, mouse
gtcccagagaggaagtgcgt

SEQ ID NO: 841650 - DNA, 20 bp, mouse
gaggtcagaggtctcgagaa

SEQ ID NO: 841651 - DNA, 20 bp, mouse
gggcgcatgcgcagcccgtg

SEQ ID NO: 841652 - DNA, 20 bp, mouse
gcccgtggggcgtgcacact

SEQ ID NO: 841653 - DNA, 20 bp, mouse
gaccggaagcagctaccatc

SEQ ID NO: 841654 - DNA, 20 bp, mouse
gcaagcacctggggttgctg

SEQ ID NO: 841655 - DNA, 20 bp, mouse
gtcggcccggcgaggcgctc

SEQ ID NO: 841656 - DNA, 20 bp, mouse
gacgcccccgccgaacggac

SEQ ID NO: 841657 - DNA, 20 bp, mouse
gctctcccgagcgatctcag

SEQ ID NO: 841658 - DNA, 20 bp, mouse
gcccgccgaacggaccggga

SEQ ID NO: 841659 - DNA, 20 bp, mouse
gagggctggcgttgtcttct

SEQ ID NO: 841660 - DNA, 20 bp, mouse
gcgccccactgagatcgctc

SEQ ID NO: 841661 - DNA, 20 bp, mouse
gcctccagggcccagtgata

SEQ ID NO: 841662 - DNA, 20 bp, mouse
gataaggcaagcttgtgcaa

SEQ ID NO: 841663 - DNA, 20 bp, mouse
ggcagcacacaggacctcca

SEQ ID NO: 841664 - DNA, 20 bp, mouse
gggcgcgcagcccgtgcccc

SEQ ID NO: 841665 - DNA, 20 bp, mouse
ggcctctcagcctggggcac

SEQ ID NO: 841666 - DNA, 20 bp, mouse
gacgccccgcctcccgatgg

SEQ ID NO: 841667 - DNA, 20 bp, mouse
ggcgctgattggcctaccgt

SEQ ID NO: 841668 - DNA, 20 bp, mouse
gtggggccgccatcgggagg

SEQ ID NO: 841669 - DNA, 20 bp, mouse
ggctcctccgagttggtggt

SEQ ID NO: 841670 - DNA, 20 bp, mouse
gggctggggccgccatcggg

SEQ ID NO: 841671 - DNA, 20 bp, mouse
gcggaggagccaaaacacgg

SEQ ID NO: 841672 - DNA, 20 bp, mouse
gcggggcgtgatgcgctgat

SEQ ID NO: 841673 - DNA, 20 bp, mouse
gctgaccgcgttctgattgg

SEQ ID NO: 841674 - DNA, 20 bp, mouse
gacctccaccaatcagaacg

SEQ ID NO: 841675 - DNA, 20 bp, mouse
gggagccaaaacacggaggc

SEQ ID NO: 841676 - DNA, 20 bp, mouse
gtaaaggggcggagcgtcga

SEQ ID NO: 841677 - DNA, 20 bp, mouse
ggatccctgcggaccctaag

SEQ ID NO: 841678 - DNA, 20 bp, mouse
gcactgagagggtaagactc

SEQ ID NO: 841679 - DNA, 20 bp, mouse
gtgcaggaacccttcagctc

SEQ ID NO: 841680 - DNA, 20 bp, mouse
gcccacccgccccgaccaat

SEQ ID NO: 841681 - DNA, 20 bp, mouse
ggggataagaggcgcggcca

SEQ ID NO: 841682 - DNA, 20 bp, mouse
gtcggctcctcccattggtc

SEQ ID NO: 841683 - DNA, 20 bp, mouse
ggggtaagactcgggataag

SEQ ID NO: 841684 - DNA, 20 bp, mouse
gagactcgggataagaggcg

SEQ ID NO: 841685 - DNA, 20 bp, mouse
gccgcagggatccttcagta

SEQ ID NO: 841686 - DNA, 20 bp, mouse
gagcgagaggaactatgtgg

SEQ ID NO: 841687 - DNA, 20 bp, mouse
gaggaactatgtggaggcgg

SEQ ID NO: 841688 - DNA, 20 bp, mouse
gcgaccgcacgctttaatag

SEQ ID NO: 841689 - DNA, 20 bp, mouse
ggatccctacgtcacgggag

SEQ ID NO: 841690 - DNA, 20 bp, mouse
gcggctggctaacacagctc

SEQ ID NO: 841691 - DNA, 20 bp, mouse
gttaatagtgggttctctat

SEQ ID NO: 841692 - DNA, 20 bp, mouse
ggagatggtgacattgcttg

SEQ ID NO: 841693 - DNA, 20 bp, mouse
gatagtgggttctctatagg

SEQ ID NO: 841694 - DNA, 20 bp, mouse
gagtacttgaagattgaacg

SEQ ID NO: 841695 - DNA, 20 bp, mouse
gcaccctctcccgtgacgta

SEQ ID NO: 841696 - DNA, 20 bp, mouse
gcaagagcagtgtttcgtgg

SEQ ID NO: 841697 - DNA, 20 bp, mouse
ggaggcggatccgtgcgggg

SEQ ID NO: 841698 - DNA, 20 bp, mouse
gagcgagcgcgagagggaaa

SEQ ID NO: 841699 - DNA, 20 bp, mouse
ggcagtgtttcgtggcgggg

SEQ ID NO: 841700 - DNA, 20 bp, mouse
ggatggaggcggatccgtgc

SEQ ID NO: 841701 - DNA, 20 bp, mouse
gtactggagtcacgtgatgg

SEQ ID NO: 841702 - DNA, 20 bp, mouse
gactcaagagcagtgtttcg

SEQ ID NO: 841703 - DNA, 20 bp, mouse
gcctcagcacgtgacgcgaa

SEQ ID NO: 841704 - DNA, 20 bp, mouse
gcgcgagagcgagcgcgaga

SEQ ID NO: 841705 - DNA, 20 bp, mouse
ggtcacgtgctgagggacgc

SEQ ID NO: 841706 - DNA, 20 bp, mouse
gccgcactgtggaagccggt

SEQ ID NO: 841707 - DNA, 20 bp, mouse
ggggagcaggagtctggaac

SEQ ID NO: 841708 - DNA, 20 bp, mouse
gcagaccgcactgtggaagc

SEQ ID NO: 841709 - DNA, 20 bp, mouse
gctgggccgaagttcatcac

SEQ ID NO: 841710 - DNA, 20 bp, mouse
gtggaacaggcttctctcat

SEQ ID NO: 841711 - DNA, 20 bp, mouse
gctgtggaagccggtgggtt

SEQ ID NO: 841712 - DNA, 20 bp, mouse
ggtgtcagagagatcaaaaa

SEQ ID NO: 841713 - DNA, 20 bp, mouse
ggacacggaggctaaggtcc

SEQ ID NO: 841714 - DNA, 20 bp, mouse
gcctgtttgcacaatgttcg

SEQ ID NO: 841715 - DNA, 20 bp, mouse
gggtttggaagccactgctg

SEQ ID NO: 841716 - DNA, 20 bp, mouse
gcaagccaagggcagagcta

SEQ ID NO: 841717 - DNA, 20 bp, mouse
gcgcccgcgccggcccaagc

SEQ ID NO: 841718 - DNA, 20 bp, mouse
gaatccagccagcccagctt

SEQ ID NO: 841719 - DNA, 20 bp, mouse
gcgcgggcgctttaagagag

SEQ ID NO: 841720 - DNA, 20 bp, mouse
ggggcgctttaagagagggg

SEQ ID NO: 841721 - DNA, 20 bp, mouse
gtgaagcccggaggcccaga

SEQ ID NO: 841722 - DNA, 20 bp, mouse
gaaggcagggcctgcccaca

SEQ ID NO: 841723 - DNA, 20 bp, mouse
gacagaaggtctccagaagt

SEQ ID NO: 841724 - DNA, 20 bp, mouse
gggatcgatatgcaagccaa

SEQ ID NO: 841725 - DNA, 20 bp, mouse
gtcacgtttcatttgatcat

SEQ ID NO: 841726 - DNA, 20 bp, mouse
gaaaacgcctaattggtctg

SEQ ID NO: 841727 - DNA, 20 bp, mouse
gaggaagacaacagctacgt

SEQ ID NO: 841728 - DNA, 20 bp, mouse
gcccgcggaactactttcgg

SEQ ID NO: 841729 - DNA, 20 bp, mouse
gcactgagctcagtgacgag

SEQ ID NO: 841730 - DNA, 20 bp, mouse
gcggatgaatccaagttaaa

SEQ ID NO: 841731 - DNA, 20 bp, mouse
ggacctccaccaatcagcgt

SEQ ID NO: 841732 - DNA, 20 bp, mouse
gcagcgctggcgccgcaagg

SEQ ID NO: 841733 - DNA, 20 bp, mouse
gggccctccctcgaaagctc

SEQ ID NO: 841734 - DNA, 20 bp, mouse
gacagacgctgcataaatag

SEQ ID NO: 841735 - DNA, 20 bp, mouse
ggaactactttcggtggcgc

SEQ ID NO: 841736 - DNA, 20 bp, mouse
gagggcagggctgtgacctc

SEQ ID NO: 841737 - DNA, 20 bp, mouse
gcggcctggcgcccctagtc

SEQ ID NO: 841738 - DNA, 20 bp, mouse
ggtggcgtccagagattgag

SEQ ID NO: 841739 - DNA, 20 bp, mouse
ggtaacgccgggtccagtct

SEQ ID NO: 841740 - DNA, 20 bp, mouse
gaggaggcgaggtcaccaat

SEQ ID NO: 841741 - DNA, 20 bp, mouse
gtcagcgcgcgtgagacgat

SEQ ID NO: 841742 - DNA, 20 bp, mouse
gtcacggagttgtttcacgg

SEQ ID NO: 841743 - DNA, 20 bp, mouse
gcctgcgccaaggcccgctc

SEQ ID NO: 841744 - DNA, 20 bp, mouse
gcgacaggctaaaactatca

SEQ ID NO: 841745 - DNA, 20 bp, mouse
gacctcgggcgactccgcgg

SEQ ID NO: 841746 - DNA, 20 bp, mouse
gaatacagatagattggcta

SEQ ID NO: 841747 - DNA, 20 bp, mouse
ggctggggtagagttcataa

SEQ ID NO: 841748 - DNA, 20 bp, mouse
gtaagataggaattttgccc

SEQ ID NO: 841749 - DNA, 20 bp, mouse
gggcagaactaaggcaggat

SEQ ID NO: 841750 - DNA, 20 bp, mouse
gctgcagtccaggctcattt

SEQ ID NO: 841751 - DNA, 20 bp, mouse
gagctgggcagaactaaggc

SEQ ID NO: 841752 - DNA, 20 bp, mouse
gtggaagattagtagtagct

SEQ ID NO: 841753 - DNA, 20 bp, mouse
gggcaggattgggagaaggt

SEQ ID NO: 841754 - DNA, 20 bp, mouse
gtggacaacacattgaactt

SEQ ID NO: 841755 - DNA, 20 bp, mouse
gctattctatgcacagaact

SEQ ID NO: 841756 - DNA, 20 bp, mouse
ggccctggacctaagggagg

SEQ ID NO: 841757 - DNA, 20 bp, mouse
gaggaggtggccaagttccc

SEQ ID NO: 841758 - DNA, 20 bp, mouse
gaggtggccaagttccctgg

SEQ ID NO: 841759 - DNA, 20 bp, mouse
gagccctggccctggaccta

SEQ ID NO: 841760 - DNA, 20 bp, mouse
gacgtcccacctgagagccc

SEQ ID NO: 841761 - DNA, 20 bp, mouse
gccggcggaccgtaccaagg

SEQ ID NO: 841762 - DNA, 20 bp, mouse
gtaccaaggcggccacgggg

SEQ ID NO: 841763 - DNA, 20 bp, mouse
gcaggtgggacgtgattgac

SEQ ID NO: 841764 - DNA, 20 bp, mouse
gtcccttaggtccagggcca

SEQ ID NO: 841765 - DNA, 20 bp, mouse
gacctcctcccttaggtcca

SEQ ID NO: 841766 - DNA, 20 bp, mouse
gcgcgcgcgccgcaccggag

SEQ ID NO: 841767 - DNA, 20 bp, mouse
ggggcagaaggcggccttcc

SEQ ID NO: 841768 - DNA, 20 bp, mouse
gtgcttgcgggcaactacgg

SEQ ID NO: 841769 - DNA, 20 bp, mouse
ggcaccggaggggcagaagg

SEQ ID NO: 841770 - DNA, 20 bp, mouse
ggcgaggcgaggtagcgtgt

SEQ ID NO: 841771 - DNA, 20 bp, mouse
gtgcccgcaagcaacaagcc

SEQ ID NO: 841772 - DNA, 20 bp, mouse
gcggcccggcccaacgccct

SEQ ID NO: 841773 - DNA, 20 bp, mouse
gaggccgccttctgcccctc

SEQ ID NO: 841774 - DNA, 20 bp, mouse
gcgcaagcaacaagcccgga

SEQ ID NO: 841775 - DNA, 20 bp, mouse
ggcagcggccgaatcactgt

SEQ ID NO: 841776 - DNA, 20 bp, mouse
gcaatcgtggcgcgttactg

SEQ ID NO: 841777 - DNA, 20 bp, mouse
ggtaacgcgccacgattgga

SEQ ID NO: 841778 - DNA, 20 bp, mouse
ggaaccccgactcctgtcgc

SEQ ID NO: 841779 - DNA, 20 bp, mouse
gcgtgcctcagctagccaat

SEQ ID NO: 841780 - DNA, 20 bp, mouse
gacgccccgccgtccaatcg

SEQ ID NO: 841781 - DNA, 20 bp, mouse
ggaggggcggcgaatacacg

SEQ ID NO: 841782 - DNA, 20 bp, mouse
gggacctagcagttgcgcag

SEQ ID NO: 841783 - DNA, 20 bp, mouse
gttaactaacgaatcggtgg

SEQ ID NO: 841784 - DNA, 20 bp, mouse
gaggccagcgacaggagtcg

SEQ ID NO: 841785 - DNA, 20 bp, mouse
gacgcgccacgattggacgg

SEQ ID NO: 841786 - DNA, 20 bp, mouse
gcactggaaggatgttggat

SEQ ID NO: 841787 - DNA, 20 bp, mouse
gccccagtggccgctctagt

SEQ ID NO: 841788 - DNA, 20 bp, mouse
gacctccactggaaggatgt

SEQ ID NO: 841789 - DNA, 20 bp, mouse
gggctagagcgccacctacc

SEQ ID NO: 841790 - DNA, 20 bp, mouse
gggaagagagcgcactgccg

SEQ ID NO: 841791 - DNA, 20 bp, mouse
gagagctgacctccactgga

SEQ ID NO: 841792 - DNA, 20 bp, mouse
gtacaggtggtacttcccat

SEQ ID NO: 841793 - DNA, 20 bp, mouse
gagtaggatgaggtagataa

SEQ ID NO: 841794 - DNA, 20 bp, mouse
gcttctctggatagttgagt

SEQ ID NO: 841795 - DNA, 20 bp, mouse
gtagagcggccactggggca

SEQ ID NO: 841796 - DNA, 20 bp, mouse
gacgtcgtccggtcacccgt

SEQ ID NO: 841797 - DNA, 20 bp, mouse
gtggtcgcagctgtcaccca

SEQ ID NO: 841798 - DNA, 20 bp, mouse
gcgcccgcgcggacgtcgtc

SEQ ID NO: 841799 - DNA, 20 bp, mouse
gtgaccggacgacgtccgcg

SEQ ID NO: 841800 - DNA, 20 bp, mouse
gggcggcagaggccgagcct

SEQ ID NO: 841801 - DNA, 20 bp, mouse
gtgcgaggaggagcgagccg

SEQ ID NO: 841802 - DNA, 20 bp, mouse
gggaagtgtagtcccaggct

SEQ ID NO: 841803 - DNA, 20 bp, mouse
ggctccttcccagcaagcga

SEQ ID NO: 841804 - DNA, 20 bp, mouse
ggagaccttgctctgcagag

SEQ ID NO: 841805 - DNA, 20 bp, mouse
ggctctgcagagcggctgca

SEQ ID NO: 841806 - DNA, 20 bp, mouse
gcagtcacgcagggtaccag

SEQ ID NO: 841807 - DNA, 20 bp, mouse
gggcgcaagcacagccgcag

SEQ ID NO: 841808 - DNA, 20 bp, mouse
gctcaggccttggcgaaggg

SEQ ID NO: 841809 - DNA, 20 bp, mouse
gtgctctcaggccttggcga

SEQ ID NO: 841810 - DNA, 20 bp, mouse
gagggtgggcccaggccgag

SEQ ID NO: 841811 - DNA, 20 bp, mouse
gtcaactggacaggactcga

SEQ ID NO: 841812 - DNA, 20 bp, mouse
ggggtccacccttctctgta

SEQ ID NO: 841813 - DNA, 20 bp, mouse
gcgtagggtgctcgcagggg

SEQ ID NO: 841814 - DNA, 20 bp, mouse
ggggccgcgccagcggcgga

SEQ ID NO: 841815 - DNA, 20 bp, mouse
ggccttggcgaaggggggtg

SEQ ID NO: 841816 - DNA, 20 bp, mouse
gcgagctgcgcaagctgcgt

SEQ ID NO: 841817 - DNA, 20 bp, mouse
gacagttggtcagggatgat

SEQ ID NO: 841818 - DNA, 20 bp, mouse
gccgccggaccctctgccca

SEQ ID NO: 841819 - DNA, 20 bp, mouse
gatgggattggcagcgtagt

SEQ ID NO: 841820 - DNA, 20 bp, mouse
ggagggatccgcagaggcta

SEQ ID NO: 841821 - DNA, 20 bp, mouse
gcagcttgcgcagctcggga

SEQ ID NO: 841822 - DNA, 20 bp, mouse
gtggcacgagccctgggcag

SEQ ID NO: 841823 - DNA, 20 bp, mouse
gcctctgcggatccctccgc

SEQ ID NO: 841824 - DNA, 20 bp, mouse
gcgctactggcacgagccct

SEQ ID NO: 841825 - DNA, 20 bp, mouse
gttgtgctatgatgtcttga

SEQ ID NO: 841826 - DNA, 20 bp, mouse
gagaaggtgctgttccgaca

SEQ ID NO: 841827 - DNA, 20 bp, mouse
gcgagccgaggggttcaggg

SEQ ID NO: 841828 - DNA, 20 bp, mouse
ggtccactcggcccgagcga

SEQ ID NO: 841829 - DNA, 20 bp, mouse
gttggcggacggatacgcgg

SEQ ID NO: 841830 - DNA, 20 bp, mouse
gcgccccgcgctcgcgacgg

SEQ ID NO: 841831 - DNA, 20 bp, mouse
gcgaggggttcaggggggag

SEQ ID NO: 841832 - DNA, 20 bp, mouse
gcggtttgcttccctcgctc

SEQ ID NO: 841833 - DNA, 20 bp, mouse
gcgccggcaaccccccccct

SEQ ID NO: 841834 - DNA, 20 bp, mouse
gccactcagggaggggcgtg

SEQ ID NO: 841835 - DNA, 20 bp, mouse
ggctaaagcgatcggaggtc

SEQ ID NO: 841836 - DNA, 20 bp, mouse
gctcctgagcgctgcggccc

SEQ ID NO: 841837 - DNA, 20 bp, mouse
gtacctgggccgcagcgctc

SEQ ID NO: 841838 - DNA, 20 bp, mouse
gactaactgcataatctaga

SEQ ID NO: 841839 - DNA, 20 bp, mouse
ggcagcctaaggcagctacc

SEQ ID NO: 841840 - DNA, 20 bp, mouse
gcggcccaggtagctgcctt

SEQ ID NO: 841841 - DNA, 20 bp, mouse
gtactgccattcactataac

SEQ ID NO: 841842 - DNA, 20 bp, mouse
ggaagaccagttatagtgaa

SEQ ID NO: 841843 - DNA, 20 bp, mouse
gtacatgctcctgagcgctg

SEQ ID NO: 841844 - DNA, 20 bp, mouse
gatggcagtaacggtgtact

SEQ ID NO: 841845 - DNA, 20 bp, mouse
gttagaaatctacaccacag

SEQ ID NO: 841846 - DNA, 20 bp, mouse
ggtggggtcagcgtcgggta

SEQ ID NO: 841847 - DNA, 20 bp, mouse
gttagaataatgtaggggag

SEQ ID NO: 841848 - DNA, 20 bp, mouse
gtcattgtggggtcagcgtc

SEQ ID NO: 841849 - DNA, 20 bp, mouse
gtggcactttagtcattgtg

SEQ ID NO: 841850 - DNA, 20 bp, mouse
gattatagtgagtactagag

SEQ ID NO: 841851 - DNA, 20 bp, mouse
gggaggggcatgttgggaaa

SEQ ID NO: 841852 - DNA, 20 bp, mouse
gtgtaggggaggggcatgtt

SEQ ID NO: 841853 - DNA, 20 bp, mouse
ggtaacttttaataaaaagg

SEQ ID NO: 841854 - DNA, 20 bp, mouse
gtaaaaaggtggcagaaatg

SEQ ID NO: 841855 - DNA, 20 bp, mouse
gaaaaaataagtccttgctc

SEQ ID NO: 841856 - DNA, 20 bp, mouse
gtcaatgtggggtcaacgtg

SEQ ID NO: 841857 - DNA, 20 bp, mouse
ggggagcagcgtgttaggaa

SEQ ID NO: 841858 - DNA, 20 bp, mouse
gtcacagagagcatcagtac

SEQ ID NO: 841859 - DNA, 20 bp, mouse
ggggcaccttagtcaatgtg

SEQ ID NO: 841860 - DNA, 20 bp, mouse
ggttgaccccacattgacta

SEQ ID NO: 841861 - DNA, 20 bp, mouse
ggtggggtcaacgtggggtg

SEQ ID NO: 841862 - DNA, 20 bp, mouse
gtaaaatcaaacaagtacag

SEQ ID NO: 841863 - DNA, 20 bp, mouse
gtcatagagcagttggtctt

SEQ ID NO: 841864 - DNA, 20 bp, mouse
gtgaaggggagcagcgtgtt

SEQ ID NO: 841865 - DNA, 20 bp, mouse
gtattgtagtgagtagtagg

SEQ ID NO: 841866 - DNA, 20 bp, mouse
gcgggagccccgagcgaccc

SEQ ID NO: 841867 - DNA, 20 bp, mouse
gaccaggggaagttcttccc

SEQ ID NO: 841868 - DNA, 20 bp, mouse
ggggccgcggcccccaggtg

SEQ ID NO: 841869 - DNA, 20 bp, mouse
gcggagccgaggcaaccggg

SEQ ID NO: 841870 - DNA, 20 bp, mouse
ggggcggagccgaggcaacc

SEQ ID NO: 841871 - DNA, 20 bp, mouse
ggccccgagcgaccccggct

SEQ ID NO: 841872 - DNA, 20 bp, mouse
ggtggagcccggggtgacca

SEQ ID NO: 841873 - DNA, 20 bp, mouse
gtggcctggggacgccgcgc

SEQ ID NO: 841874 - DNA, 20 bp, mouse
gcgggctccacctgccccag

SEQ ID NO: 841875 - DNA, 20 bp, mouse
ggagtgagggggccggtgtg

SEQ ID NO: 841876 - DNA, 20 bp, mouse
gcaacggcggcgggaaggga

SEQ ID NO: 841877 - DNA, 20 bp, mouse
gccggagcaaaggcgggtta

SEQ ID NO: 841878 - DNA, 20 bp, mouse
gacaccgcgaggccgacgtg

SEQ ID NO: 841879 - DNA, 20 bp, mouse
ggagggaaatcgaggctcaa

SEQ ID NO: 841880 - DNA, 20 bp, mouse
ggggcgggccggagcaaagg

SEQ ID NO: 841881 - DNA, 20 bp, mouse
gcggactgggatgaggggta

SEQ ID NO: 841882 - DNA, 20 bp, mouse
gcgggttagggcgaagggaa

SEQ ID NO: 841883 - DNA, 20 bp, mouse
gtaaagtgacagctgagtcc

SEQ ID NO: 841884 - DNA, 20 bp, mouse
ggacacgcgggctaaggggt

SEQ ID NO: 841885 - DNA, 20 bp, mouse
gttagggcgaagggaaaggg

SEQ ID NO: 841886 - DNA, 20 bp, mouse
gcgccggcccctaacctcag

SEQ ID NO: 841887 - DNA, 20 bp, mouse
gcgcgtgctcgctgcttgcc

SEQ ID NO: 841888 - DNA, 20 bp, mouse
gtcgctgcttgcctggcgga

SEQ ID NO: 841889 - DNA, 20 bp, mouse
gcgctccgggagccacggtg

SEQ ID NO: 841890 - DNA, 20 bp, mouse
gcaaagagcgcggcggggac

SEQ ID NO: 841891 - DNA, 20 bp, mouse
gctctgccggccgaaggcga

SEQ ID NO: 841892 - DNA, 20 bp, mouse
gggcgaaggcgcagggacgc

SEQ ID NO: 841893 - DNA, 20 bp, mouse
gtcttccagtacgagctcgg

SEQ ID NO: 841894 - DNA, 20 bp, mouse
ggccgagccgagcgcagcgg

SEQ ID NO: 841895 - DNA, 20 bp, mouse
ggggctggcccctgcgccct

SEQ ID NO: 841896 - DNA, 20 bp, mouse
ggtcggggatgcttgcgctt

SEQ ID NO: 841897 - DNA, 20 bp, mouse
gtcctgtgactgtccacgag

SEQ ID NO: 841898 - DNA, 20 bp, mouse
gctagtcggccctcgttcat

SEQ ID NO: 841899 - DNA, 20 bp, mouse
ggaagagcacggcctgaggg

SEQ ID NO: 841900 - DNA, 20 bp, mouse
gtccactcgtggacagtcac

SEQ ID NO: 841901 - DNA, 20 bp, mouse
ggctcttcaccaatgaacga

SEQ ID NO: 841902 - DNA, 20 bp, mouse
gggtgaagagcacggcctga

SEQ ID NO: 841903 - DNA, 20 bp, mouse
gcatacacaggtcaactagt

SEQ ID NO: 841904 - DNA, 20 bp, mouse
gtgacacatggcccaccctc

SEQ ID NO: 841905 - DNA, 20 bp, mouse
gcggctcccggcggcgagac

SEQ ID NO: 841906 - DNA, 20 bp, mouse
ggacgcttccgcagctgggc

SEQ ID NO: 841907 - DNA, 20 bp, mouse
gcagccccgccatcttggga

SEQ ID NO: 841908 - DNA, 20 bp, mouse
gcagctgcggaagcgtcggc

SEQ ID NO: 841909 - DNA, 20 bp, mouse
gggaccttcccaagatggcg

SEQ ID NO: 841910 - DNA, 20 bp, mouse
ggcagcagggccgaggggtc

SEQ ID NO: 841911 - DNA, 20 bp, mouse
gggcgtggaccttcccaaga

SEQ ID NO: 841912 - DNA, 20 bp, mouse
ggcgggggaaggcaccggtg

SEQ ID NO: 841913 - DNA, 20 bp, mouse
gtcggctggtagacgccccg

SEQ ID NO: 841914 - DNA, 20 bp, mouse
ggaccagaagtggtagatgt

SEQ ID NO: 841915 - DNA, 20 bp, mouse
gatgacaaagaggtcgcgga

SEQ ID NO: 841916 - DNA, 20 bp, mouse
gcgacccgggccattacccg

SEQ ID NO: 841917 - DNA, 20 bp, mouse
gtggccggccgagaagattc

SEQ ID NO: 841918 - DNA, 20 bp, mouse
ggcacccgggtgcttcagac

SEQ ID NO: 841919 - DNA, 20 bp, mouse
gggcccgggtcgacggagct

SEQ ID NO: 841920 - DNA, 20 bp, mouse
gcgctccccgggtaatggcc

SEQ ID NO: 841921 - DNA, 20 bp, mouse
ggcgacccggaagcagtcgt

SEQ ID NO: 841922 - DNA, 20 bp, mouse
gcaaagcctcacggcggcgt

SEQ ID NO: 841923 - DNA, 20 bp, mouse
ggctgcgcaaagcctcacgg

SEQ ID NO: 841924 - DNA, 20 bp, mouse
ggaccggcgcggatgtggcg

SEQ ID NO: 841925 - DNA, 20 bp, mouse
ggccacaccctcagcattga

SEQ ID NO: 841926 - DNA, 20 bp, mouse
ggggcggagggaatgcacga

SEQ ID NO: 841927 - DNA, 20 bp, mouse
gcctctcaacagtgctgcaa

SEQ ID NO: 841928 - DNA, 20 bp, mouse
ggggaggagcatcgtcgtcg

SEQ ID NO: 841929 - DNA, 20 bp, mouse
gaagtgtgtgaggaggttgg

SEQ ID NO: 841930 - DNA, 20 bp, mouse
gggagggaatgcacgatggc

SEQ ID NO: 841931 - DNA, 20 bp, mouse
gcgcggtgtaagcttgtcag

SEQ ID NO: 841932 - DNA, 20 bp, mouse
ggggcggggcgccggtggga

SEQ ID NO: 841933 - DNA, 20 bp, mouse
gatcgatgaagtgtgtgagg

SEQ ID NO: 841934 - DNA, 20 bp, mouse
gatgttgatggtaacgacac

SEQ ID NO: 841935 - DNA, 20 bp, mouse
gccctcagatgacgtcacag

SEQ ID NO: 841936 - DNA, 20 bp, mouse
gggaccttggtctctcattg

SEQ ID NO: 841937 - DNA, 20 bp, mouse
gaggcggtcgcgggcaacga

SEQ ID NO: 841938 - DNA, 20 bp, mouse
gtctgtacccccaacagatc

SEQ ID NO: 841939 - DNA, 20 bp, mouse
gagggcgcggcagccgcgtg

SEQ ID NO: 841940 - DNA, 20 bp, mouse
ggggctccttaggcggtcgc

SEQ ID NO: 841941 - DNA, 20 bp, mouse
gtccaagtctggtggctcct

SEQ ID NO: 841942 - DNA, 20 bp, mouse
gtgggctcgggctccttagg

SEQ ID NO: 841943 - DNA, 20 bp, mouse
gggtgaggaagcatccgagc

SEQ ID NO: 841944 - DNA, 20 bp, mouse
gaaacagcttccaagtctgg

SEQ ID NO: 841945 - DNA, 20 bp, mouse
ggcttcccgcagcccgcacg

SEQ ID NO: 841946 - DNA, 20 bp, mouse
gacgaagcgcccgccacgtc

SEQ ID NO: 841947 - DNA, 20 bp, mouse
gggtgccgcccgtctcccca

SEQ ID NO: 841948 - DNA, 20 bp, mouse
ggcctgcgggactgacgtcc

SEQ ID NO: 841949 - DNA, 20 bp, mouse
gggcgccggcggtgacgcag

SEQ ID NO: 841950 - DNA, 20 bp, mouse
gggtccgcctccctgagggc

SEQ ID NO: 841951 - DNA, 20 bp, mouse
gggcccttcaggggttcccg

SEQ ID NO: 841952 - DNA, 20 bp, mouse
gtgaagtcggcctgacgtgg

SEQ ID NO: 841953 - DNA, 20 bp, mouse
gcgagcgcggcctgggactg

SEQ ID NO: 841954 - DNA, 20 bp, mouse
gtctcccgggctgggccgag

SEQ ID NO: 841955 - DNA, 20 bp, mouse
gctccgcgggaacccctgaa

SEQ ID NO: 841956 - DNA, 20 bp, mouse
gccagacagtacgaagtctt

SEQ ID NO: 841957 - DNA, 20 bp, mouse
gaggctgcttgcggcgggtg

SEQ ID NO: 841958 - DNA, 20 bp, mouse
ggccgcgttcaggttcgccg

SEQ ID NO: 841959 - DNA, 20 bp, mouse
ggcactagagaatagctcgg

SEQ ID NO: 841960 - DNA, 20 bp, mouse
ggggttgtggctcctgtgtc

SEQ ID NO: 841961 - DNA, 20 bp, mouse
gcaaccctttgcgcagtagc

SEQ ID NO: 841962 - DNA, 20 bp, mouse
ggccgctccggggacggcct

SEQ ID NO: 841963 - DNA, 20 bp, mouse
gccgtgagccgcacccgcgc

SEQ ID NO: 841964 - DNA, 20 bp, mouse
ggcggcgaggctgcttgcgg

SEQ ID NO: 841965 - DNA, 20 bp, mouse
gcactccaggaaccagtaag

SEQ ID NO: 841966 - DNA, 20 bp, mouse
ggcgccgcgcgtctcagccg

SEQ ID NO: 841967 - DNA, 20 bp, mouse
gagccacgcggccgaagccc

SEQ ID NO: 841968 - DNA, 20 bp, mouse
gaggcccagaccccgcggac

SEQ ID NO: 841969 - DNA, 20 bp, mouse
gtccgccctgccggcggctg

SEQ ID NO: 841970 - DNA, 20 bp, mouse
gtcgctgctggagacgtatg

SEQ ID NO: 841971 - DNA, 20 bp, mouse
gaagccccggctgagacgcg

SEQ ID NO: 841972 - DNA, 20 bp, mouse
gtatggggctcccactggag

SEQ ID NO: 841973 - DNA, 20 bp, mouse
gcacctcgggtcccagccta

SEQ ID NO: 841974 - DNA, 20 bp, mouse
gccctcctggccccagccgc

SEQ ID NO: 841975 - DNA, 20 bp, mouse
gcgtggctccgccctgccgg

SEQ ID NO: 841976 - DNA, 20 bp, mouse
ggggctaaccgggaagagcg

SEQ ID NO: 841977 - DNA, 20 bp, mouse
gtatggcgcctccaatccta

SEQ ID NO: 841978 - DNA, 20 bp, mouse
gcccgctccaggaagtgagg

SEQ ID NO: 841979 - DNA, 20 bp, mouse
gttggaggcgccataaagta

SEQ ID NO: 841980 - DNA, 20 bp, mouse
gtatgtacttgccataggat

SEQ ID NO: 841981 - DNA, 20 bp, mouse
gaggtcactcgagtctacac

SEQ ID NO: 841982 - DNA, 20 bp, mouse
gtcccccgctccaggaagtg

SEQ ID NO: 841983 - DNA, 20 bp, mouse
gagcgggggaggggctaacc

SEQ ID NO: 841984 - DNA, 20 bp, mouse
gcactgtatgtacttgccat

SEQ ID NO: 841985 - DNA, 20 bp, mouse
gaccccctcacttcctggag

SEQ ID NO: 841986 - DNA, 20 bp, mouse
ggcaagatgcaggaaccaag

SEQ ID NO: 841987 - DNA, 20 bp, mouse
gcagctagagtcggtgtggg

SEQ ID NO: 841988 - DNA, 20 bp, mouse
gagatcagagactacgtcgg

SEQ ID NO: 841989 - DNA, 20 bp, mouse
gtgcagatcagagactacgt

SEQ ID NO: 841990 - DNA, 20 bp, mouse
gggtacatctcgtagaagcc

SEQ ID NO: 841991 - DNA, 20 bp, mouse
gttgcagctagagtcggtgt

SEQ ID NO: 841992 - DNA, 20 bp, mouse
gcctccagatatccaccaaa

SEQ ID NO: 841993 - DNA, 20 bp, mouse
gcacccctttggtggatatc

SEQ ID NO: 841994 - DNA, 20 bp, mouse
gctctctgcgacctccgcaa

SEQ ID NO: 841995 - DNA, 20 bp, mouse
gagtttgctctcagcgtccg

SEQ ID NO: 841996 - DNA, 20 bp, mouse
ggggcctcaccagacccaag

SEQ ID NO: 841997 - DNA, 20 bp, mouse
gcagacccaagcggaagagg

SEQ ID NO: 841998 - DNA, 20 bp, mouse
gagggcgcggggaccgtagc

SEQ ID NO: 841999 - DNA, 20 bp, mouse
gtaccgcagggtaccggtgg

SEQ ID NO: 842000 - DNA, 20 bp, mouse
gcaagtaggcgggagagcgg

SEQ ID NO: 842001 - DNA, 20 bp, mouse
gagcctccaccggtaccctg

SEQ ID NO: 842002 - DNA, 20 bp, mouse
gtcctccccctcttccgctt

SEQ ID NO: 842003 - DNA, 20 bp, mouse
ggcagggtaccgcagggtac

SEQ ID NO: 842004 - DNA, 20 bp, mouse
ggagagcggcggacctgtaa

SEQ ID NO: 842005 - DNA, 20 bp, mouse
ggaggctgcggtgaggtgga

SEQ ID NO: 842006 - DNA, 20 bp, mouse
gagggggccaccaggtcgga

SEQ ID NO: 842007 - DNA, 20 bp, mouse
gaatgaatgggctgcgtcgg

SEQ ID NO: 842008 - DNA, 20 bp, mouse
gcgcggcggggcagggactt

SEQ ID NO: 842009 - DNA, 20 bp, mouse
gcgaccacgcctgcgtcggg

SEQ ID NO: 842010 - DNA, 20 bp, mouse
gggccaccaggtcggaggga

SEQ ID NO: 842011 - DNA, 20 bp, mouse
gtcggggggcgacgtaacaa

SEQ ID NO: 842012 - DNA, 20 bp, mouse
ggccacccccggctggggtt

SEQ ID NO: 842013 - DNA, 20 bp, mouse
gggggagggggccaccaggt

SEQ ID NO: 842014 - DNA, 20 bp, mouse
gtcccgaggggcctcggcgg

SEQ ID NO: 842015 - DNA, 20 bp, mouse
ggtcgcgcgctcctcctcgg

SEQ ID NO: 842016 - DNA, 20 bp, mouse
gtcccctagcgaccgggcgg

SEQ ID NO: 842017 - DNA, 20 bp, mouse
gagccgccgcccggtcgcta

SEQ ID NO: 842018 - DNA, 20 bp, mouse
ggggccgagcgcgctgacgt

SEQ ID NO: 842019 - DNA, 20 bp, mouse
gaggggacgctgaagatgct

SEQ ID NO: 842020 - DNA, 20 bp, mouse
gacgctgaagatgcttgggg

SEQ ID NO: 842021 - DNA, 20 bp, mouse
ggactgccgcggggcgtggc

SEQ ID NO: 842022 - DNA, 20 bp, mouse
gctgaagatgcttggggcgg

SEQ ID NO: 842023 - DNA, 20 bp, mouse
gcatcccggcgccctaacga

SEQ ID NO: 842024 - DNA, 20 bp, mouse
gcaggaacgaagatggatta

SEQ ID NO: 842025 - DNA, 20 bp, mouse
gtagaccagtacccttcctc

SEQ ID NO: 842026 - DNA, 20 bp, mouse
gggcctagggtcacatgtgg

SEQ ID NO: 842027 - DNA, 20 bp, mouse
gcccctgggaacacaggcac

SEQ ID NO: 842028 - DNA, 20 bp, mouse
ggtgacaggcgcgggccggg

SEQ ID NO: 842029 - DNA, 20 bp, mouse
ggcttcgagcagcgaggcga

SEQ ID NO: 842030 - DNA, 20 bp, mouse
gggggggcgggaaagacgcg

SEQ ID NO: 842031 - DNA, 20 bp, mouse
ggcttccggcggccgtgggg

SEQ ID NO: 842032 - DNA, 20 bp, mouse
ggcagcgaggcgagggccta

SEQ ID NO: 842033 - DNA, 20 bp, mouse
ggagggcctagggtcacatg

SEQ ID NO: 842034 - DNA, 20 bp, mouse
gcgccggcccacccccccca

SEQ ID NO: 842035 - DNA, 20 bp, mouse
gacgcgcggatcacgtgccg

SEQ ID NO: 842036 - DNA, 20 bp, mouse
ggccgccggcccaaatcctc

SEQ ID NO: 842037 - DNA, 20 bp, mouse
gcccaccgccgcctgggaga

SEQ ID NO: 842038 - DNA, 20 bp, mouse
gccccggtgtggggcggaaa

SEQ ID NO: 842039 - DNA, 20 bp, mouse
gaaaggggctgggtcatgag

SEQ ID NO: 842040 - DNA, 20 bp, mouse
ggaggcgcgcaggggagctc

SEQ ID NO: 842041 - DNA, 20 bp, mouse
gggcgcggagccccggtgtg

SEQ ID NO: 842042 - DNA, 20 bp, mouse
ggcggagccccggtgtgggg

SEQ ID NO: 842043 - DNA, 20 bp, mouse
gtgtggggcggaaaggggct

SEQ ID NO: 842044 - DNA, 20 bp, mouse
ggcagccctctcccaggcgg

SEQ ID NO: 842045 - DNA, 20 bp, mouse
gaaatcctcggggcgagcgg

SEQ ID NO: 842046 - DNA, 20 bp, mouse
gcgcccgcaccattttctcc

SEQ ID NO: 842047 - DNA, 20 bp, mouse
gtaccgctgtctccccccag

SEQ ID NO: 842048 - DNA, 20 bp, mouse
gacacacgcacggccgctgg

SEQ ID NO: 842049 - DNA, 20 bp, mouse
gtggcctgagcgtgctaata

SEQ ID NO: 842050 - DNA, 20 bp, mouse
gtcctgcggcgacacacgca

SEQ ID NO: 842051 - DNA, 20 bp, mouse
gggcggaaagcgggatgaaa

SEQ ID NO: 842052 - DNA, 20 bp, mouse
ggcgacacacgcacggccgc

SEQ ID NO: 842053 - DNA, 20 bp, mouse
ggcggagggggcggcactgc

SEQ ID NO: 842054 - DNA, 20 bp, mouse
ggctcaggccagccctcccc

SEQ ID NO: 842055 - DNA, 20 bp, mouse
gcggcactgccggccgggag

SEQ ID NO: 842056 - DNA, 20 bp, mouse
gcggaggggcgcacgaggga

SEQ ID NO: 842057 - DNA, 20 bp, mouse
gccaccgtggggcctggccg

SEQ ID NO: 842058 - DNA, 20 bp, mouse
ggtgcgctggggtctcggga

SEQ ID NO: 842059 - DNA, 20 bp, mouse
gaagcggaggtggggatcaa

SEQ ID NO: 842060 - DNA, 20 bp, mouse
ggcccccgcggagaacgaga

SEQ ID NO: 842061 - DNA, 20 bp, mouse
ggggcggctcgcggcgacag

SEQ ID NO: 842062 - DNA, 20 bp, mouse
gacaaagcgcagccaccgtg

SEQ ID NO: 842063 - DNA, 20 bp, mouse
gaaagagccaagcggaggtg

SEQ ID NO: 842064 - DNA, 20 bp, mouse
ggggtcgcagaggattactt

SEQ ID NO: 842065 - DNA, 20 bp, mouse
ggggccggaggggcgcacga

SEQ ID NO: 842066 - DNA, 20 bp, mouse
gaggagtgctatcacaatga

SEQ ID NO: 842067 - DNA, 20 bp, mouse
ggggcggagcgagggaagac

SEQ ID NO: 842068 - DNA, 20 bp, mouse
gccggctgaggagttgacct

SEQ ID NO: 842069 - DNA, 20 bp, mouse
ggcgactaacggttaggcag

SEQ ID NO: 842070 - DNA, 20 bp, mouse
gtcacaatgagggctcacgc

SEQ ID NO: 842071 - DNA, 20 bp, mouse
gagttcgaacccagtttgtg

SEQ ID NO: 842072 - DNA, 20 bp, mouse
gcggtcgagacgtgccgtga

SEQ ID NO: 842073 - DNA, 20 bp, mouse
gcgtcaacgcgcacgttgct

SEQ ID NO: 842074 - DNA, 20 bp, mouse
gaacggttaggcaggggaag

SEQ ID NO: 842075 - DNA, 20 bp, mouse
gagcggccacgtcgcctcgg

SEQ ID NO: 842076 - DNA, 20 bp, mouse
gagcggacgcaagctctgag

SEQ ID NO: 842077 - DNA, 20 bp, mouse
gaggctgggaagtcatctac

SEQ ID NO: 842078 - DNA, 20 bp, mouse
gtaggagtgccaggagtctc

SEQ ID NO: 842079 - DNA, 20 bp, mouse
gaatttgagcggtgcgtgag

SEQ ID NO: 842080 - DNA, 20 bp, mouse
ggtgcgcgcgccaatttgag

SEQ ID NO: 842081 - DNA, 20 bp, mouse
gtggtccgcagcaaacctgg

SEQ ID NO: 842082 - DNA, 20 bp, mouse
ggaggcgcgcgcccgcctat

SEQ ID NO: 842083 - DNA, 20 bp, mouse
ggggaagtcatctacaggag

SEQ ID NO: 842084 - DNA, 20 bp, mouse
gaatcgactgtgagctggga

SEQ ID NO: 842085 - DNA, 20 bp, mouse
gtccaggagaggactgtgat

SEQ ID NO: 842086 - DNA, 20 bp, mouse
gtggtgtccgggtgcactga

SEQ ID NO: 842087 - DNA, 20 bp, mouse
gcccggacaccagtggggta

SEQ ID NO: 842088 - DNA, 20 bp, mouse
gtccgggtgcactgaggggt

SEQ ID NO: 842089 - DNA, 20 bp, mouse
gcccctaccccactggtgtc

SEQ ID NO: 842090 - DNA, 20 bp, mouse
gggaagaccccctaccccac

SEQ ID NO: 842091 - DNA, 20 bp, mouse
gagtgcacccggacaccagt

SEQ ID NO: 842092 - DNA, 20 bp, mouse
gtaatcagctaccggactgt

SEQ ID NO: 842093 - DNA, 20 bp, mouse
gacaaacagtttcagtggga

SEQ ID NO: 842094 - DNA, 20 bp, mouse
gaagacaggggatgaataac

SEQ ID NO: 842095 - DNA, 20 bp, mouse
ggctaagaggacctacagtc

SEQ ID NO: 842096 - DNA, 20 bp, mouse
ggtgagcgagcatgagggcg

SEQ ID NO: 842097 - DNA, 20 bp, mouse
ggaagcgcacggtcaccccg

SEQ ID NO: 842098 - DNA, 20 bp, mouse
ggacgcccgctcggggtcgc

SEQ ID NO: 842099 - DNA, 20 bp, mouse
ggaccccgagcgggcgtcag

SEQ ID NO: 842100 - DNA, 20 bp, mouse
gcccgcgctcgggctgggcg

SEQ ID NO: 842101 - DNA, 20 bp, mouse
ggagccccgcgcctgttccc

SEQ ID NO: 842102 - DNA, 20 bp, mouse
gcggctcctgcgaccccgag

SEQ ID NO: 842103 - DNA, 20 bp, mouse
ggtgccgctgacgcccgctc

SEQ ID NO: 842104 - DNA, 20 bp, mouse
gggggaggcgtgcaggtgct

SEQ ID NO: 842105 - DNA, 20 bp, mouse
gcgcttccgggagaatagaa

SEQ ID NO: 842106 - DNA, 20 bp, mouse
gaaactgggttgggagacta

SEQ ID NO: 842107 - DNA, 20 bp, mouse
gaccgatagtggggatagtg

SEQ ID NO: 842108 - DNA, 20 bp, mouse
gacggagagcaacgcgctgc

SEQ ID NO: 842109 - DNA, 20 bp, mouse
gtctggaactgttggttcat

SEQ ID NO: 842110 - DNA, 20 bp, mouse
gcatagagggaccgatagtg

SEQ ID NO: 842111 - DNA, 20 bp, mouse
gggcaaagcttgccaggaac

SEQ ID NO: 842112 - DNA, 20 bp, mouse
gcagttccagagaccatcag

SEQ ID NO: 842113 - DNA, 20 bp, mouse
gcgttgctctccgtcataga

SEQ ID NO: 842114 - DNA, 20 bp, mouse
ggggaattcacaattgtgtt

SEQ ID NO: 842115 - DNA, 20 bp, mouse
gaacagttacatcacgagcc

SEQ ID NO: 842116 - DNA, 20 bp, mouse
gggtgggcccgcgtataaat

SEQ ID NO: 842117 - DNA, 20 bp, mouse
gcacccgcgcgctagccaat

SEQ ID NO: 842118 - DNA, 20 bp, mouse
gctgggatgcaaggtaccta

SEQ ID NO: 842119 - DNA, 20 bp, mouse
gggcccgcgtataaattggc

SEQ ID NO: 842120 - DNA, 20 bp, mouse
ggctccgccccctgcgtctc

SEQ ID NO: 842121 - DNA, 20 bp, mouse
gaggggcccgcgtgtccgat

SEQ ID NO: 842122 - DNA, 20 bp, mouse
gcggaggcgctgctccaggt

SEQ ID NO: 842123 - DNA, 20 bp, mouse
gcacgcgggccccttcccat

SEQ ID NO: 842124 - DNA, 20 bp, mouse
ggtggagtcgccgatgggaa

SEQ ID NO: 842125 - DNA, 20 bp, mouse
gagcgcgcgggtgcccgggg

SEQ ID NO: 842126 - DNA, 20 bp, mouse
gccccgctctggaggaccgt

SEQ ID NO: 842127 - DNA, 20 bp, mouse
gcggggcgcagaatctgcgc

SEQ ID NO: 842128 - DNA, 20 bp, mouse
gggaccgtgggtggacgctc

SEQ ID NO: 842129 - DNA, 20 bp, mouse
gtccccagcccgggtggcgc

SEQ ID NO: 842130 - DNA, 20 bp, mouse
gctccgcccggaccagcgag

SEQ ID NO: 842131 - DNA, 20 bp, mouse
gcgctctggaggaccgtggg

SEQ ID NO: 842132 - DNA, 20 bp, mouse
gctggcagcacgcctctcgc

SEQ ID NO: 842133 - DNA, 20 bp, mouse
gtggtccgggcggaggtggg

SEQ ID NO: 842134 - DNA, 20 bp, mouse
gcgcctctcgctggtccggg

SEQ ID NO: 842135 - DNA, 20 bp, mouse
gcccccgccccccgctctgg

SEQ ID NO: 842136 - DNA, 20 bp, mouse
ggcgcaggggcctttgggaa

SEQ ID NO: 842137 - DNA, 20 bp, mouse
gcgccaaccctgccgggcga

SEQ ID NO: 842138 - DNA, 20 bp, mouse
ggcgaaggcgagctagagga

SEQ ID NO: 842139 - DNA, 20 bp, mouse
gcgcgtgcgtgggatggcga

SEQ ID NO: 842140 - DNA, 20 bp, mouse
ggcccctgcgccgcaggcga

SEQ ID NO: 842141 - DNA, 20 bp, mouse
gcacagagctgcgatcgggg

SEQ ID NO: 842142 - DNA, 20 bp, mouse
gaggcggggttgcgcgtgcg

SEQ ID NO: 842143 - DNA, 20 bp, mouse
gccgcctcgcatcccgcctc

SEQ ID NO: 842144 - DNA, 20 bp, mouse
gagtccggaggcgggatgcg

SEQ ID NO: 842145 - DNA, 20 bp, mouse
ggcaggcgaaggcgagctag

SEQ ID NO: 842146 - DNA, 20 bp, mouse
gcctctgcggggcggaagtg

SEQ ID NO: 842147 - DNA, 20 bp, mouse
ggggccggggcgggcacttc

SEQ ID NO: 842148 - DNA, 20 bp, mouse
gtgactcggccaaggggagg

SEQ ID NO: 842149 - DNA, 20 bp, mouse
gccgccccgaagctccccga

SEQ ID NO: 842150 - DNA, 20 bp, mouse
gtaaacgcctgactcggcca

SEQ ID NO: 842151 - DNA, 20 bp, mouse
gcccgtaagccctagatggg

SEQ ID NO: 842152 - DNA, 20 bp, mouse
gggagcttcggggcgggcga

SEQ ID NO: 842153 - DNA, 20 bp, mouse
gacccccgtaagccctagat

SEQ ID NO: 842154 - DNA, 20 bp, mouse
gggaacgaacgagggttcga

SEQ ID NO: 842155 - DNA, 20 bp, mouse
gaaaggagccgtggtcgggg

SEQ ID NO: 842156 - DNA, 20 bp, mouse
gcgcacgcaggcaagtccaa

SEQ ID NO: 842157 - DNA, 20 bp, mouse
gagcgcgggcaccgacgcca

SEQ ID NO: 842158 - DNA, 20 bp, mouse
gcggaaggatgttgcacccg

SEQ ID NO: 842159 - DNA, 20 bp, mouse
gcgacccggtcggcgtcaat

SEQ ID NO: 842160 - DNA, 20 bp, mouse
gaggagcaccgtattatcga

SEQ ID NO: 842161 - DNA, 20 bp, mouse
gtcggtgcccgcgctcgcgg

SEQ ID NO: 842162 - DNA, 20 bp, mouse
gtcaccctccagctagatgt

SEQ ID NO: 842163 - DNA, 20 bp, mouse
gagggccgccatcgataata

SEQ ID NO: 842164 - DNA, 20 bp, mouse
gaagtccaagggctgccggg

SEQ ID NO: 842165 - DNA, 20 bp, mouse
ggaacgtgcgcggtcatcga

SEQ ID NO: 842166 - DNA, 20 bp, mouse
gggcagctagcgagggtggg

SEQ ID NO: 842167 - DNA, 20 bp, mouse
gcggaagtggctttgggatt

SEQ ID NO: 842168 - DNA, 20 bp, mouse
gccggaagtagggcggtgtc

SEQ ID NO: 842169 - DNA, 20 bp, mouse
ggacagagaaaacaccgagg

SEQ ID NO: 842170 - DNA, 20 bp, mouse
gtgctggcagctagcgaggg

SEQ ID NO: 842171 - DNA, 20 bp, mouse
gttaccccgcgccggaagta

SEQ ID NO: 842172 - DNA, 20 bp, mouse
gccccgcgccggaagtaggg

SEQ ID NO: 842173 - DNA, 20 bp, mouse
gggcgcatgcgcacgtttgc

SEQ ID NO: 842174 - DNA, 20 bp, mouse
ggtggggggcgggccggaag

SEQ ID NO: 842175 - DNA, 20 bp, mouse
gttggaaatccatctcttga

SEQ ID NO: 842176 - DNA, 20 bp, mouse
gtggcgccgctcagggaaga

SEQ ID NO: 842177 - DNA, 20 bp, mouse
ggggctgctaagaggagacg

SEQ ID NO: 842178 - DNA, 20 bp, mouse
gggcgagaggggctgctaag

SEQ ID NO: 842179 - DNA, 20 bp, mouse
ggcggggcggacagtcacca

SEQ ID NO: 842180 - DNA, 20 bp, mouse
ggagactgagcggaggcgag

SEQ ID NO: 842181 - DNA, 20 bp, mouse
gggcccaggtagaattgctg

SEQ ID NO: 842182 - DNA, 20 bp, mouse
gcaagcgaagaggaaatcgg

SEQ ID NO: 842183 - DNA, 20 bp, mouse
gtccctgagcggcgccaggc

SEQ ID NO: 842184 - DNA, 20 bp, mouse
gctgctaagaggagacgagg

SEQ ID NO: 842185 - DNA, 20 bp, mouse
gggaagggccatattcggat

SEQ ID NO: 842186 - DNA, 20 bp, mouse
gctcacgcccctctggacta

SEQ ID NO: 842187 - DNA, 20 bp, mouse
gcgtgagcagcccagatagg

SEQ ID NO: 842188 - DNA, 20 bp, mouse
gcatcgccgccctagtccag

SEQ ID NO: 842189 - DNA, 20 bp, mouse
ggggcgtgagcagcccagat

SEQ ID NO: 842190 - DNA, 20 bp, mouse
gtgggctgctcacgcccctc

SEQ ID NO: 842191 - DNA, 20 bp, mouse
gtggccctcgggcaccgcgt

SEQ ID NO: 842192 - DNA, 20 bp, mouse
gccggcccgggaagcggagg

SEQ ID NO: 842193 - DNA, 20 bp, mouse
ggcgctcggtccccgagcgg

SEQ ID NO: 842194 - DNA, 20 bp, mouse
gcggcgatgcgccgccgctc

SEQ ID NO: 842195 - DNA, 20 bp, mouse
ggcccgagggccaccacgtg

SEQ ID NO: 842196 - DNA, 20 bp, mouse
ggaggggcgtggtcggagag

SEQ ID NO: 842197 - DNA, 20 bp, mouse
gcggagaggggtgtggtcaa

SEQ ID NO: 842198 - DNA, 20 bp, mouse
gcgacacgccctgaaatccc

SEQ ID NO: 842199 - DNA, 20 bp, mouse
gtagccctcctgggatttca

SEQ ID NO: 842200 - DNA, 20 bp, mouse
ggaacttgggagacgacgac

SEQ ID NO: 842201 - DNA, 20 bp, mouse
gcggaaactcggacctgggg

SEQ ID NO: 842202 - DNA, 20 bp, mouse
gttagctaaaagcaagtcac

SEQ ID NO: 842203 - DNA, 20 bp, mouse
gcgcacaatactttcaacgt

SEQ ID NO: 842204 - DNA, 20 bp, mouse
ggcccggtgaaggccggcga

SEQ ID NO: 842205 - DNA, 20 bp, mouse
ggcgtggtcggagaggggtg

SEQ ID NO: 842206 - DNA, 20 bp, mouse
gtgaggggaaggggcctccg

SEQ ID NO: 842207 - DNA, 20 bp, mouse
gcgggggcgtggcatcgatg

SEQ ID NO: 842208 - DNA, 20 bp, mouse
gagccctctcggagcatcat

SEQ ID NO: 842209 - DNA, 20 bp, mouse
ggatgcgggcaaggacgccc

SEQ ID NO: 842210 - DNA, 20 bp, mouse
ggggctgaggcgatgacagg

SEQ ID NO: 842211 - DNA, 20 bp, mouse
gaggaggaggcggagagtca

SEQ ID NO: 842212 - DNA, 20 bp, mouse
gcctcagcccaacatggcgg

SEQ ID NO: 842213 - DNA, 20 bp, mouse
gggcgtgtgggattgagaag

SEQ ID NO: 842214 - DNA, 20 bp, mouse
gagggctccgttgtgacgaa

SEQ ID NO: 842215 - DNA, 20 bp, mouse
gggtgcccgagagccgactt

SEQ ID NO: 842216 - DNA, 20 bp, mouse
gacggccggggcagaagcga

SEQ ID NO: 842217 - DNA, 20 bp, mouse
gtctacccaaggcacggccg

SEQ ID NO: 842218 - DNA, 20 bp, mouse
gtctgccccggccgtgcctt

SEQ ID NO: 842219 - DNA, 20 bp, mouse
gttaatggcgcggggacgtg

SEQ ID NO: 842220 - DNA, 20 bp, mouse
gtgggtagagtccaccacct

SEQ ID NO: 842221 - DNA, 20 bp, mouse
gcgccattaagcccaggtgg

SEQ ID NO: 842222 - DNA, 20 bp, mouse
gtccaagtgaggtacctgtg

SEQ ID NO: 842223 - DNA, 20 bp, mouse
gtaagcaagcctggccccac

SEQ ID NO: 842224 - DNA, 20 bp, mouse
gccggccttcgcttctgccc

SEQ ID NO: 842225 - DNA, 20 bp, mouse
gccgccggaagccgtgaaag

SEQ ID NO: 842226 - DNA, 20 bp, mouse
gggacagcagaggggcattg

SEQ ID NO: 842227 - DNA, 20 bp, mouse
gagagcaggaaaagtactca

SEQ ID NO: 842228 - DNA, 20 bp, mouse
ggacagagttgggggagagt

SEQ ID NO: 842229 - DNA, 20 bp, mouse
gtgaccaggaaagaaaatgt

SEQ ID NO: 842230 - DNA, 20 bp, mouse
gaggctctgggcagactctg

SEQ ID NO: 842231 - DNA, 20 bp, mouse
gaaccagcggccatgctgtt

SEQ ID NO: 842232 - DNA, 20 bp, mouse
gagaactttagggacagcag

SEQ ID NO: 842233 - DNA, 20 bp, mouse
gacagctcctagtagggcaa

SEQ ID NO: 842234 - DNA, 20 bp, mouse
gagctagtggctgcccatgt

SEQ ID NO: 842235 - DNA, 20 bp, mouse
gtcaaggcagacaccattag

SEQ ID NO: 842236 - DNA, 20 bp, mouse
gccgcggtaggaggattgtc

SEQ ID NO: 842237 - DNA, 20 bp, mouse
gaaacggtcactacgaccag

SEQ ID NO: 842238 - DNA, 20 bp, mouse
gtaggaggattgtctggctt

SEQ ID NO: 842239 - DNA, 20 bp, mouse
ggccctgcatgactccattt

SEQ ID NO: 842240 - DNA, 20 bp, mouse
gcccgccgctgagatccttt

SEQ ID NO: 842241 - DNA, 20 bp, mouse
ggctaagaatggatttacag

SEQ ID NO: 842242 - DNA, 20 bp, mouse
gacctaaaggatctcagcgg

SEQ ID NO: 842243 - DNA, 20 bp, mouse
gggaacccggaagcacctaa

SEQ ID NO: 842244 - DNA, 20 bp, mouse
gttacagcggacgttggaac

SEQ ID NO: 842245 - DNA, 20 bp, mouse
ggcagccgggattccgcggt

SEQ ID NO: 842246 - DNA, 20 bp, mouse
gtggagagcgcgggaatcat

SEQ ID NO: 842247 - DNA, 20 bp, mouse
gacagaaagctacaacctac

SEQ ID NO: 842248 - DNA, 20 bp, mouse
gaacccgtccccctcggaga

SEQ ID NO: 842249 - DNA, 20 bp, mouse
ggaagcctgttggttgtccc

SEQ ID NO: 842250 - DNA, 20 bp, mouse
gtgcgagcacgagcagtttg

SEQ ID NO: 842251 - DNA, 20 bp, mouse
gcagctagtggcaatgcttc

SEQ ID NO: 842252 - DNA, 20 bp, mouse
gaatgcttccgggtcctagg

SEQ ID NO: 842253 - DNA, 20 bp, mouse
gaaggctcgccctccggcct

SEQ ID NO: 842254 - DNA, 20 bp, mouse
gctggacggccatttataag

SEQ ID NO: 842255 - DNA, 20 bp, mouse
gcacaagaggctggctacgt

SEQ ID NO: 842256 - DNA, 20 bp, mouse
gggctccgcaggcgtcacat

SEQ ID NO: 842257 - DNA, 20 bp, mouse
gcggccaccaagaaccggga

SEQ ID NO: 842258 - DNA, 20 bp, mouse
gtgcgcagaacagccggcgg

SEQ ID NO: 842259 - DNA, 20 bp, mouse
gtccgcaggcgtcacatcgg

SEQ ID NO: 842260 - DNA, 20 bp, mouse
gacgcctgcggagcccaggc

SEQ ID NO: 842261 - DNA, 20 bp, mouse
gggcggcggccaccaagaac

SEQ ID NO: 842262 - DNA, 20 bp, mouse
gacactgccacaggagtcac

SEQ ID NO: 842263 - DNA, 20 bp, mouse
gggagcatgcgcagaacagc

SEQ ID NO: 842264 - DNA, 20 bp, mouse
gtcctccgatgtgacgcctg

SEQ ID NO: 842265 - DNA, 20 bp, mouse
ggacccctcccggttcttgg

SEQ ID NO: 842266 - DNA, 20 bp, mouse
gcggcaccgcccattggagt

SEQ ID NO: 842267 - DNA, 20 bp, mouse
gtggtcaggccaactccaat

SEQ ID NO: 842268 - DNA, 20 bp, mouse
gacagcaaacacccgtcacg

SEQ ID NO: 842269 - DNA, 20 bp, mouse
gttcccggctgcccgtgcgg

SEQ ID NO: 842270 - DNA, 20 bp, mouse
gtgacgtcagcgcatccgct

SEQ ID NO: 842271 - DNA, 20 bp, mouse
gcggccggactagcgcgaaa

SEQ ID NO: 842272 - DNA, 20 bp, mouse
gaaccctgaggccatcccag

SEQ ID NO: 842273 - DNA, 20 bp, mouse
gcgtcagcgcatccgctagg

SEQ ID NO: 842274 - DNA, 20 bp, mouse
gtgtcacgagccggagggga

SEQ ID NO: 842275 - DNA, 20 bp, mouse
gacggcggagagtggggaag

SEQ ID NO: 842276 - DNA, 20 bp, mouse
gcggaagtgacgtcacagac

SEQ ID NO: 842277 - DNA, 20 bp, mouse
gtggaggccagacagctcgg

SEQ ID NO: 842278 - DNA, 20 bp, mouse
gcacgctcgccgatccctta

SEQ ID NO: 842279 - DNA, 20 bp, mouse
gcgagaggaggaaatcactc

SEQ ID NO: 842280 - DNA, 20 bp, mouse
gggaacagggttgtcagctg

SEQ ID NO: 842281 - DNA, 20 bp, mouse
ggacgctcaccctaagggat

SEQ ID NO: 842282 - DNA, 20 bp, mouse
gcccgcccgacgttggcctc

SEQ ID NO: 842283 - DNA, 20 bp, mouse
gacagacaggcctgtctccg

SEQ ID NO: 842284 - DNA, 20 bp, mouse
gatcgcgacgctcaccctaa

SEQ ID NO: 842285 - DNA, 20 bp, mouse
gacgctcgcgtccacagtcg

SEQ ID NO: 842286 - DNA, 20 bp, mouse
ggctccggtaccaacgtaag

SEQ ID NO: 842287 - DNA, 20 bp, mouse
gtatgcaaggatcccggcat

SEQ ID NO: 842288 - DNA, 20 bp, mouse
gagggccgctggccggaagt

SEQ ID NO: 842289 - DNA, 20 bp, mouse
ggagcagaagtaattggcac

SEQ ID NO: 842290 - DNA, 20 bp, mouse
gtgaccttagaacatggaga

SEQ ID NO: 842291 - DNA, 20 bp, mouse
gagagggaaaaatattatcc

SEQ ID NO: 842292 - DNA, 20 bp, mouse
gtttccctctccatgttcta

SEQ ID NO: 842293 - DNA, 20 bp, mouse
gcaacgtaagcggaaggtga

SEQ ID NO: 842294 - DNA, 20 bp, mouse
ggctggccggaagtgggttg

SEQ ID NO: 842295 - DNA, 20 bp, mouse
ggaaaaatattatcctggat

SEQ ID NO: 842296 - DNA, 20 bp, mouse
ggcggcggaagaggtgtgac

SEQ ID NO: 842297 - DNA, 20 bp, mouse
gcgggaacgcagaggctcac

SEQ ID NO: 842298 - DNA, 20 bp, mouse
gcggtgtcgcggcctggcgg

SEQ ID NO: 842299 - DNA, 20 bp, mouse
gaggggaagagcgttttgat

SEQ ID NO: 842300 - DNA, 20 bp, mouse
gcccggcccccgcggtgtcg

SEQ ID NO: 842301 - DNA, 20 bp, mouse
gaggtgtgaccggttacgct

SEQ ID NO: 842302 - DNA, 20 bp, mouse
gggcggggaccttttaggga

SEQ ID NO: 842303 - DNA, 20 bp, mouse
gcccccgcggtgtcgcggcc

SEQ ID NO: 842304 - DNA, 20 bp, mouse
gtcccagaaccgacggaagt

SEQ ID NO: 842305 - DNA, 20 bp, mouse
gggaagagcgttttgattgg

SEQ ID NO: 842306 - DNA, 20 bp, mouse
gacgaagcgcgggctcctca

SEQ ID NO: 842307 - DNA, 20 bp, mouse
ggcgggctcctcaaggtcga

SEQ ID NO: 842308 - DNA, 20 bp, mouse
gcgcccacggggaccaggtg

SEQ ID NO: 842309 - DNA, 20 bp, mouse
ggagcccgcgcttcgtccgc

SEQ ID NO: 842310 - DNA, 20 bp, mouse
gagcgctgccatgcatgagt

SEQ ID NO: 842311 - DNA, 20 bp, mouse
gtagccgcgccgactcctgg

SEQ ID NO: 842312 - DNA, 20 bp, mouse
gggcacgccgggtagcgcgt

SEQ ID NO: 842313 - DNA, 20 bp, mouse
gctacccggcgtgcctcgcg

SEQ ID NO: 842314 - DNA, 20 bp, mouse
gtcaaggtcgatggagtgct

SEQ ID NO: 842315 - DNA, 20 bp, mouse
ggcggccggccgccaggagt

SEQ ID NO: 842316 - DNA, 20 bp, mouse
gcagcccagcgagcgtctcg

SEQ ID NO: 842317 - DNA, 20 bp, mouse
gcggccgcgagacgctcgct

SEQ ID NO: 842318 - DNA, 20 bp, mouse
ggccccgccccctgctgacg

SEQ ID NO: 842319 - DNA, 20 bp, mouse
gagaatgagcgcccggttgg

SEQ ID NO: 842320 - DNA, 20 bp, mouse
gaactcctgccctgcagagg

SEQ ID NO: 842321 - DNA, 20 bp, mouse
ggcgaggcgggcgaggcgag

SEQ ID NO: 842322 - DNA, 20 bp, mouse
gccaggggaccaaggcgagg

SEQ ID NO: 842323 - DNA, 20 bp, mouse
ggcgccgcgtcagcaggggg

SEQ ID NO: 842324 - DNA, 20 bp, mouse
gctggcgccgcgtcagcagg

SEQ ID NO: 842325 - DNA, 20 bp, mouse
gcaatctgggaggcagtgaa

SEQ ID NO: 842326 - DNA, 20 bp, mouse
gggctggaactcattctatc

SEQ ID NO: 842327 - DNA, 20 bp, mouse
ggaatgagttccagcccaga

SEQ ID NO: 842328 - DNA, 20 bp, mouse
gtggggaatttgggattacc

SEQ ID NO: 842329 - DNA, 20 bp, mouse
gctctagtatccatggtgag

SEQ ID NO: 842330 - DNA, 20 bp, mouse
gtcggagtctctagtatcca

SEQ ID NO: 842331 - DNA, 20 bp, mouse
gccaggaactctgatcacct

SEQ ID NO: 842332 - DNA, 20 bp, mouse
gttaataatagaagttaagt

SEQ ID NO: 842333 - DNA, 20 bp, mouse
gaattagatgcaatttagat

SEQ ID NO: 842334 - DNA, 20 bp, mouse
gtatctaacaaatagaagcg

SEQ ID NO: 842335 - DNA, 20 bp, mouse
gtttagatgggtatatttac

SEQ ID NO: 842336 - DNA, 20 bp, mouse
gcctccgcgctgtccggccc

SEQ ID NO: 842337 - DNA, 20 bp, mouse
gccagctgcgcaccctgctc

SEQ ID NO: 842338 - DNA, 20 bp, mouse
ggcggagggcgggagattca

SEQ ID NO: 842339 - DNA, 20 bp, mouse
gacagcgccccgggcggcct

SEQ ID NO: 842340 - DNA, 20 bp, mouse
ggcagccacagcgccccggg

SEQ ID NO: 842341 - DNA, 20 bp, mouse
gccggcccggcccgactccg

SEQ ID NO: 842342 - DNA, 20 bp, mouse
ggcgcaccctgctcgggcct

SEQ ID NO: 842343 - DNA, 20 bp, mouse
gccagggaacggagataaga

SEQ ID NO: 842344 - DNA, 20 bp, mouse
ggggcggcccaggcccgagc

SEQ ID NO: 842345 - DNA, 20 bp, mouse
ggacgtccttaagacctctg

SEQ ID NO: 842346 - DNA, 20 bp, mouse
gagatcatgcccttaggggt

SEQ ID NO: 842347 - DNA, 20 bp, mouse
gggggtgggacagctgtgaa

SEQ ID NO: 842348 - DNA, 20 bp, mouse
gaaatgggaatgaataaatt

SEQ ID NO: 842349 - DNA, 20 bp, mouse
gacagctgtcccacccctaa

SEQ ID NO: 842350 - DNA, 20 bp, mouse
gaatagtagcaataatgtat

SEQ ID NO: 842351 - DNA, 20 bp, mouse
gtgatcagatcatgccctta

SEQ ID NO: 842352 - DNA, 20 bp, mouse
gacaatacatcatgatgaaa

SEQ ID NO: 842353 - DNA, 20 bp, mouse
gctctctagcccagaatgtg

SEQ ID NO: 842354 - DNA, 20 bp, mouse
gtgctactattattatttac

SEQ ID NO: 842355 - DNA, 20 bp, mouse
gtataaaaaccacacattct

SEQ ID NO: 842356 - DNA, 20 bp, mouse
gcaccagggctgatccccga

SEQ ID NO: 842357 - DNA, 20 bp, mouse
gcatcaggggcggaaacctc

SEQ ID NO: 842358 - DNA, 20 bp, mouse
gctgccccggggttaaggga

SEQ ID NO: 842359 - DNA, 20 bp, mouse
ggctaactaaccatcagggg

SEQ ID NO: 842360 - DNA, 20 bp, mouse
gctagtccatccgtcggtaa

SEQ ID NO: 842361 - DNA, 20 bp, mouse
gtacgacggcccctgaagtc

SEQ ID NO: 842362 - DNA, 20 bp, mouse
gcggtcggcttcccggaagc

SEQ ID NO: 842363 - DNA, 20 bp, mouse
gtgccgacctgccaagccgg

SEQ ID NO: 842364 - DNA, 20 bp, mouse
gtggccggcccgacgcgaca

SEQ ID NO: 842365 - DNA, 20 bp, mouse
gcagggctaactaaccatca

SEQ ID NO: 842366 - DNA, 20 bp, mouse
gagcggcacacgagtatcat

SEQ ID NO: 842367 - DNA, 20 bp, mouse
gtctctccctggccgctcag

SEQ ID NO: 842368 - DNA, 20 bp, mouse
gagaagcgaagcctctaata

SEQ ID NO: 842369 - DNA, 20 bp, mouse
gtggtgtcaagcccctctca

SEQ ID NO: 842370 - DNA, 20 bp, mouse
ggtgtgccgctccttattag

SEQ ID NO: 842371 - DNA, 20 bp, mouse
gaatgattattcttggtgct

SEQ ID NO: 842372 - DNA, 20 bp, mouse
gggagttgtagtccatcccc

SEQ ID NO: 842373 - DNA, 20 bp, mouse
gcacctcggtgactagtgcc

SEQ ID NO: 842374 - DNA, 20 bp, mouse
gggcaaaaacacccaagcga

SEQ ID NO: 842375 - DNA, 20 bp, mouse
gacacccaagcgagggagca

SEQ ID NO: 842376 - DNA, 20 bp, mouse
ggtggtggggagcccgacga

SEQ ID NO: 842377 - DNA, 20 bp, mouse
gccaagccccgcccctcgtc

SEQ ID NO: 842378 - DNA, 20 bp, mouse
gtggcaggagggcgtggcca

SEQ ID NO: 842379 - DNA, 20 bp, mouse
gggctggggctctgctccta

SEQ ID NO: 842380 - DNA, 20 bp, mouse
gtctgcgcggtccccgcccc

SEQ ID NO: 842381 - DNA, 20 bp, mouse
gggagggcgtggccaggggc

SEQ ID NO: 842382 - DNA, 20 bp, mouse
gcaccaccacccaccaggct

SEQ ID NO: 842383 - DNA, 20 bp, mouse
ggccgggtatcgcgagagtt

SEQ ID NO: 842384 - DNA, 20 bp, mouse
ggctgcagagcacttctgcg

SEQ ID NO: 842385 - DNA, 20 bp, mouse
gcagaagtgctctgcagcgc

SEQ ID NO: 842386 - DNA, 20 bp, mouse
gcaaccctgcgcatgctcgc

SEQ ID NO: 842387 - DNA, 20 bp, mouse
gtgcgcaggcgcactaccct

SEQ ID NO: 842388 - DNA, 20 bp, mouse
gttaagcccgcagaagtcag

SEQ ID NO: 842389 - DNA, 20 bp, mouse
gaaaaacgcaaagacctgga

SEQ ID NO: 842390 - DNA, 20 bp, mouse
gcatcctaggacagacaggg

SEQ ID NO: 842391 - DNA, 20 bp, mouse
gcttctgcgggcttaaccca

SEQ ID NO: 842392 - DNA, 20 bp, mouse
ggcttcccgcgagcatgcgc

SEQ ID NO: 842393 - DNA, 20 bp, mouse
gcaggtctttgcgtttttgt

SEQ ID NO: 842394 - DNA, 20 bp, mouse
gtgggccggtggcaagcccc

SEQ ID NO: 842395 - DNA, 20 bp, mouse
gtctcccccctgtctgtcct

SEQ ID NO: 842396 - DNA, 20 bp, mouse
gagcgcaggcggggaagaga

SEQ ID NO: 842397 - DNA, 20 bp, mouse
ggctccgcccagtgtcctga

SEQ ID NO: 842398 - DNA, 20 bp, mouse
gacactgggcggagcgcagg

SEQ ID NO: 842399 - DNA, 20 bp, mouse
gggaagccgccgggactgga

SEQ ID NO: 842400 - DNA, 20 bp, mouse
gctggagggacccgggacct

SEQ ID NO: 842401 - DNA, 20 bp, mouse
gaggacactgggcggagcgc

SEQ ID NO: 842402 - DNA, 20 bp, mouse
gcgggtccctccagtcccgg

SEQ ID NO: 842403 - DNA, 20 bp, mouse
gaagtggccttcaggacact

SEQ ID NO: 842404 - DNA, 20 bp, mouse
gacgccggggcctctccgag

SEQ ID NO: 842405 - DNA, 20 bp, mouse
ggagaggaaccggttcgcga

SEQ ID NO: 842406 - DNA, 20 bp, mouse
gttaagcggcccaatcgctg

SEQ ID NO: 842407 - DNA, 20 bp, mouse
gttcccgagcacgtgctctc

SEQ ID NO: 842408 - DNA, 20 bp, mouse
gcggccgggccccagcgatt

SEQ ID NO: 842409 - DNA, 20 bp, mouse
gcggggctccgggaaacggg

SEQ ID NO: 842410 - DNA, 20 bp, mouse
gcagcctgggcgccgatcgg

SEQ ID NO: 842411 - DNA, 20 bp, mouse
gcctgggcgccgatcggcgg

SEQ ID NO: 842412 - DNA, 20 bp, mouse
ggtggcccgacaacgttaag

SEQ ID NO: 842413 - DNA, 20 bp, mouse
gcgcatatgcacaaccatta

SEQ ID NO: 842414 - DNA, 20 bp, mouse
gcgagcccggccccccgggg

SEQ ID NO: 842415 - DNA, 20 bp, mouse
ggtcgggccacggtgctgta

SEQ ID NO: 842416 - DNA, 20 bp, mouse
gtccgggtggcgtttctccg

SEQ ID NO: 842417 - DNA, 20 bp, mouse
ggagaaacgccacccggaag

SEQ ID NO: 842418 - DNA, 20 bp, mouse
gtactcgcccgaaagctcca

SEQ ID NO: 842419 - DNA, 20 bp, mouse
gcggctacgagtgtcctgtg

SEQ ID NO: 842420 - DNA, 20 bp, mouse
gttgtgacggggagccgcag

SEQ ID NO: 842421 - DNA, 20 bp, mouse
gggaagccagcctgcggccg

SEQ ID NO: 842422 - DNA, 20 bp, mouse
gcgggccaatttcgggaaat

SEQ ID NO: 842423 - DNA, 20 bp, mouse
ggaaggacacggaagaaaat

SEQ ID NO: 842424 - DNA, 20 bp, mouse
gcctctccagagcctgtcgg

SEQ ID NO: 842425 - DNA, 20 bp, mouse
gaaaatgggcgggccaattt

SEQ ID NO: 842426 - DNA, 20 bp, mouse
gccaccccaagcgggaggaa

SEQ ID NO: 842427 - DNA, 20 bp, mouse
gcactccgagctcccagctg

SEQ ID NO: 842428 - DNA, 20 bp, mouse
ggtcacatgcgcacctgggg

SEQ ID NO: 842429 - DNA, 20 bp, mouse
gcaggtgcgcatgtgaccga

SEQ ID NO: 842430 - DNA, 20 bp, mouse
ggtggcgcggccaccccaag

SEQ ID NO: 842431 - DNA, 20 bp, mouse
gggccggggcggggttaggc

SEQ ID NO: 842432 - DNA, 20 bp, mouse
gacaccgccgcagctactcc

SEQ ID NO: 842433 - DNA, 20 bp, mouse
gaaaaccagacccggcccga

SEQ ID NO: 842434 - DNA, 20 bp, mouse
gtgggagctcggagtgatcc

SEQ ID NO: 842435 - DNA, 20 bp, mouse
gtatgcgccctcaaccgccc

SEQ ID NO: 842436 - DNA, 20 bp, mouse
gcgggggcgcggggaagtga

SEQ ID NO: 842437 - DNA, 20 bp, mouse
gaggtgggccggaaagaagg

SEQ ID NO: 842438 - DNA, 20 bp, mouse
gtggtgtggccggtgggaga

SEQ ID NO: 842439 - DNA, 20 bp, mouse
gtgcaagccgagcccggctg

SEQ ID NO: 842440 - DNA, 20 bp, mouse
ggggcttggcccatcccggg

SEQ ID NO: 842441 - DNA, 20 bp, mouse
gcccgctggaacggcctcga

SEQ ID NO: 842442 - DNA, 20 bp, mouse
gggagccgaggaaggcacgc

SEQ ID NO: 842443 - DNA, 20 bp, mouse
gccgaggccgggagagtagg

SEQ ID NO: 842444 - DNA, 20 bp, mouse
gcggggaagtgaggggcgag

SEQ ID NO: 842445 - DNA, 20 bp, mouse
gaataccgagcagaaccgag

SEQ ID NO: 842446 - DNA, 20 bp, mouse
ggggccaggcgaggccgggg

SEQ ID NO: 842447 - DNA, 20 bp, mouse
ggcgccaaggcggctctgac

SEQ ID NO: 842448 - DNA, 20 bp, mouse
gtcgtgcagcccccgagcgg

SEQ ID NO: 842449 - DNA, 20 bp, mouse
ggaggggccaggcgaggccg

SEQ ID NO: 842450 - DNA, 20 bp, mouse
gtcgcccgtcagagccgcct

SEQ ID NO: 842451 - DNA, 20 bp, mouse
gcagcccccgagcggtggga

SEQ ID NO: 842452 - DNA, 20 bp, mouse
gctggcccctccgcctcctc

SEQ ID NO: 842453 - DNA, 20 bp, mouse
ggggccgccccggcctcgcc

SEQ ID NO: 842454 - DNA, 20 bp, mouse
ggacgggcgagcgctcggag

SEQ ID NO: 842455 - DNA, 20 bp, mouse
gacctgcggggcctccggca

SEQ ID NO: 842456 - DNA, 20 bp, mouse
gttactattgacagtataag

SEQ ID NO: 842457 - DNA, 20 bp, mouse
gggaataaagctggttgtgg

SEQ ID NO: 842458 - DNA, 20 bp, mouse
gaagggaataaagctggttg

SEQ ID NO: 842459 - DNA, 20 bp, mouse
gggaacttgcctaaaaatta

SEQ ID NO: 842460 - DNA, 20 bp, mouse
gctttattcccttaattttt

SEQ ID NO: 842461 - DNA, 20 bp, mouse
gaaaatgtgtttaaaggggc

SEQ ID NO: 842462 - DNA, 20 bp, mouse
gcctttaaaatgtgtttaaa

SEQ ID NO: 842463 - DNA, 20 bp, mouse
ggatctgccttcatagtgct

SEQ ID NO: 842464 - DNA, 20 bp, mouse
gcagatctctgtaaattcaa

SEQ ID NO: 842465 - DNA, 20 bp, mouse
gaacttttatttcaaaaggt

SEQ ID NO: 842466 - DNA, 20 bp, mouse
gtcatgggaaagcttcatca

SEQ ID NO: 842467 - DNA, 20 bp, mouse
gtaaacttcacctcccttca

SEQ ID NO: 842468 - DNA, 20 bp, mouse
ggcttcatcaaggagtgtga

SEQ ID NO: 842469 - DNA, 20 bp, mouse
gtgactataagtttagagag

SEQ ID NO: 842470 - DNA, 20 bp, mouse
ggttggagtaggtgtatctt

SEQ ID NO: 842471 - DNA, 20 bp, mouse
gaatccagacttgtaacagt

SEQ ID NO: 842472 - DNA, 20 bp, mouse
gggagtaggtctgtatcaca

SEQ ID NO: 842473 - DNA, 20 bp, mouse
gtgttgctttagtcaaatat

SEQ ID NO: 842474 - DNA, 20 bp, mouse
gttgcagccttctgaagatt

SEQ ID NO: 842475 - DNA, 20 bp, mouse
gaaatgatggcaagcagctg

SEQ ID NO: 842476 - DNA, 20 bp, mouse
gtcacggggcgggagaccca

SEQ ID NO: 842477 - DNA, 20 bp, mouse
ggcgggagacccagggacga

SEQ ID NO: 842478 - DNA, 20 bp, mouse
gctggtgggcggggactttg

SEQ ID NO: 842479 - DNA, 20 bp, mouse
gtacccgccgatccatagcc

SEQ ID NO: 842480 - DNA, 20 bp, mouse
gccggcgctcgctaactcac

SEQ ID NO: 842481 - DNA, 20 bp, mouse
gctaaaagagagcctggcta

SEQ ID NO: 842482 - DNA, 20 bp, mouse
gggagacccagggacgaggg

SEQ ID NO: 842483 - DNA, 20 bp, mouse
gtctggagcttcttccccgt

SEQ ID NO: 842484 - DNA, 20 bp, mouse
gggaaggagacccacccacg

SEQ ID NO: 842485 - DNA, 20 bp, mouse
gttgaggagggacaactgac

SEQ ID NO: 842486 - DNA, 20 bp, mouse
ggaggggcagaggtggttca

SEQ ID NO: 842487 - DNA, 20 bp, mouse
gaatgtgcgttcaggggaga

SEQ ID NO: 842488 - DNA, 20 bp, mouse
gagccctgccctggagtcgg

SEQ ID NO: 842489 - DNA, 20 bp, mouse
gcgcaagctgaattggacta

SEQ ID NO: 842490 - DNA, 20 bp, mouse
gctgtggcctccatggggca

SEQ ID NO: 842491 - DNA, 20 bp, mouse
gaattggactagggcacgga

SEQ ID NO: 842492 - DNA, 20 bp, mouse
gtggactagggcacggaggg

SEQ ID NO: 842493 - DNA, 20 bp, mouse
gtcagcttgcggtccaggtc

SEQ ID NO: 842494 - DNA, 20 bp, mouse
gctggggaatgtgcgttcag

SEQ ID NO: 842495 - DNA, 20 bp, mouse
gcacaccaaggtcctgagcc

SEQ ID NO: 842496 - DNA, 20 bp, mouse
gtcaacatcttcaggtctag

SEQ ID NO: 842497 - DNA, 20 bp, mouse
gaggtcagagggcgttcttg

SEQ ID NO: 842498 - DNA, 20 bp, mouse
gcaccgctctaagaggtcag

SEQ ID NO: 842499 - DNA, 20 bp, mouse
ggggcagtgaagacgggcat

SEQ ID NO: 842500 - DNA, 20 bp, mouse
gaaccagagggcagtgaaga

SEQ ID NO: 842501 - DNA, 20 bp, mouse
gcatctttgcatgatcaggt

SEQ ID NO: 842502 - DNA, 20 bp, mouse
ggccctctgacctcttagag

SEQ ID NO: 842503 - DNA, 20 bp, mouse
gaggctctctaacgaaccag

SEQ ID NO: 842504 - DNA, 20 bp, mouse
gagagggcgttcttgaggcc

SEQ ID NO: 842505 - DNA, 20 bp, mouse
gtagtccataaattagaggg

SEQ ID NO: 842506 - DNA, 20 bp, mouse
gcggccgtgaggaaattgtc

SEQ ID NO: 842507 - DNA, 20 bp, mouse
ggcaaggcgcgcactaatgg

SEQ ID NO: 842508 - DNA, 20 bp, mouse
gaggcgcgccgagccatccc

SEQ ID NO: 842509 - DNA, 20 bp, mouse
ggctcggcgcgcctggctga

SEQ ID NO: 842510 - DNA, 20 bp, mouse
gtgacgggagcgcgcgtgga

SEQ ID NO: 842511 - DNA, 20 bp, mouse
gaggagcgagcctgactgac

SEQ ID NO: 842512 - DNA, 20 bp, mouse
ggagcgcgccggggatggct

SEQ ID NO: 842513 - DNA, 20 bp, mouse
ggccgcaaggcgcgcactaa

SEQ ID NO: 842514 - DNA, 20 bp, mouse
gaggcgcgcactaatggcgg

SEQ ID NO: 842515 - DNA, 20 bp, mouse
gtcttgcggcgggttttcct

SEQ ID NO: 842516 - DNA, 20 bp, mouse
gagtgcgcaccggctggtgg

SEQ ID NO: 842517 - DNA, 20 bp, mouse
gccggtgcgcactcgctgta

SEQ ID NO: 842518 - DNA, 20 bp, mouse
gcgcactcgctgtagggttc

SEQ ID NO: 842519 - DNA, 20 bp, mouse
gacagataaggggaaatgaa

SEQ ID NO: 842520 - DNA, 20 bp, mouse
ggggttcgtggtgttcctcc

SEQ ID NO: 842521 - DNA, 20 bp, mouse
gcatctcccagcgagtcgaa

SEQ ID NO: 842522 - DNA, 20 bp, mouse
ggaaaaactggcgagccctg

SEQ ID NO: 842523 - DNA, 20 bp, mouse
gactcgctgggagatgctgt

SEQ ID NO: 842524 - DNA, 20 bp, mouse
gactggcgagccctgcggac

SEQ ID NO: 842525 - DNA, 20 bp, mouse
ggaacaccacgaacccggca

SEQ ID NO: 842526 - DNA, 20 bp, mouse
gtcccaggaagcctcactgc

SEQ ID NO: 842527 - DNA, 20 bp, mouse
gcgcgcccccgcgaagcctc

SEQ ID NO: 842528 - DNA, 20 bp, mouse
ggaaggatgactaaccgcta

SEQ ID NO: 842529 - DNA, 20 bp, mouse
ggggcgcgcgacccctgacg

SEQ ID NO: 842530 - DNA, 20 bp, mouse
ggtactgcggggtgggaggc

SEQ ID NO: 842531 - DNA, 20 bp, mouse
ggtggaaggaagtatcagga

SEQ ID NO: 842532 - DNA, 20 bp, mouse
gtccgactccaggaagtgga

SEQ ID NO: 842533 - DNA, 20 bp, mouse
gccaccccgcagtaccacat

SEQ ID NO: 842534 - DNA, 20 bp, mouse
ggcgcgccccggtgcctggt

SEQ ID NO: 842535 - DNA, 20 bp, mouse
gggaagtggaaggaagtatc

SEQ ID NO: 842536 - DNA, 20 bp, mouse
ggtggctgctgcggtcttaa

SEQ ID NO: 842537 - DNA, 20 bp, mouse
ggggcccggccagaagctta

SEQ ID NO: 842538 - DNA, 20 bp, mouse
ggccttgcagcacctcgcgc

SEQ ID NO: 842539 - DNA, 20 bp, mouse
gggcgccatcttcctgtctg

SEQ ID NO: 842540 - DNA, 20 bp, mouse
ggagcctgtcgccccggcaa

SEQ ID NO: 842541 - DNA, 20 bp, mouse
gtagctctgggtactcttct

SEQ ID NO: 842542 - DNA, 20 bp, mouse
gagagctactggaaccaggg

SEQ ID NO: 842543 - DNA, 20 bp, mouse
gagaccgcagcagccaccag

SEQ ID NO: 842544 - DNA, 20 bp, mouse
gctgggagagacaagctaga

SEQ ID NO: 842545 - DNA, 20 bp, mouse
gtgggcgacggagagggcga

SEQ ID NO: 842546 - DNA, 20 bp, mouse
gtctccgcgagccgccgctt

SEQ ID NO: 842547 - DNA, 20 bp, mouse
gcacaggcttcaaaccaaag

SEQ ID NO: 842548 - DNA, 20 bp, mouse
gaggcttcaaaccaaagcgg

SEQ ID NO: 842549 - DNA, 20 bp, mouse
gtccgcggcgtgctgtgcgc

SEQ ID NO: 842550 - DNA, 20 bp, mouse
gcgcaaaacgcgcacagaca

SEQ ID NO: 842551 - DNA, 20 bp, mouse
gtatctccggaattcagaga

SEQ ID NO: 842552 - DNA, 20 bp, mouse
gcacagcacgccgcggagtg

SEQ ID NO: 842553 - DNA, 20 bp, mouse
ggggatgttgggattcaatg

SEQ ID NO: 842554 - DNA, 20 bp, mouse
gaacgcgcacagacagggag

SEQ ID NO: 842555 - DNA, 20 bp, mouse
gaaatcgggaggttttttgg

SEQ ID NO: 842556 - DNA, 20 bp, mouse
gcggcgcgggtcatctcctt

SEQ ID NO: 842557 - DNA, 20 bp, mouse
gaggctggtcacgatgacag

SEQ ID NO: 842558 - DNA, 20 bp, mouse
gtccctgtcctgtggatctg

SEQ ID NO: 842559 - DNA, 20 bp, mouse
gagctcgccccggaggcctc

SEQ ID NO: 842560 - DNA, 20 bp, mouse
gtgggacggtccctgtcctg

SEQ ID NO: 842561 - DNA, 20 bp, mouse
gactgtgcaggtctaaaaga

SEQ ID NO: 842562 - DNA, 20 bp, mouse
gtgcgattgctcagacggcg

SEQ ID NO: 842563 - DNA, 20 bp, mouse
gggcccgcgccccagcctca

SEQ ID NO: 842564 - DNA, 20 bp, mouse
gcagggaccgtcccagccga

SEQ ID NO: 842565 - DNA, 20 bp, mouse
gtcccagcccgaggcctccg

SEQ ID NO: 842566 - DNA, 20 bp, mouse
gcgcggggagcagctctcga

SEQ ID NO: 842567 - DNA, 20 bp, mouse
gaaaaaccgagcctggacac

SEQ ID NO: 842568 - DNA, 20 bp, mouse
gggcttcagctgcatcttcg

SEQ ID NO: 842569 - DNA, 20 bp, mouse
gtggcttgtaccattctgtg

SEQ ID NO: 842570 - DNA, 20 bp, mouse
gctcctcccagactcgggtg

SEQ ID NO: 842571 - DNA, 20 bp, mouse
gggtcgcttcgggagaaata

SEQ ID NO: 842572 - DNA, 20 bp, mouse
ggagtgagactgcaaggttt

SEQ ID NO: 842573 - DNA, 20 bp, mouse
gcggaggctcctcccagact

SEQ ID NO: 842574 - DNA, 20 bp, mouse
gaggctgcttcatgcgctca

SEQ ID NO: 842575 - DNA, 20 bp, mouse
ggagtgggagggccgcacga

SEQ ID NO: 842576 - DNA, 20 bp, mouse
ggggagagatcaagcgtctt

SEQ ID NO: 842577 - DNA, 20 bp, mouse
gtccagggctgagtctccgt

SEQ ID NO: 842578 - DNA, 20 bp, mouse
gaactcgggagctcgctcgg

SEQ ID NO: 842579 - DNA, 20 bp, mouse
gtggcgcatgcgtagaactc

SEQ ID NO: 842580 - DNA, 20 bp, mouse
gacgcgccccctagagcttc

SEQ ID NO: 842581 - DNA, 20 bp, mouse
gcaccgggccgcgtgctcgc

SEQ ID NO: 842582 - DNA, 20 bp, mouse
gagggagagtccaagtgtga

SEQ ID NO: 842583 - DNA, 20 bp, mouse
ggggagctcgctcgggggaa

SEQ ID NO: 842584 - DNA, 20 bp, mouse
ggacgcttgatctctcccta

SEQ ID NO: 842585 - DNA, 20 bp, mouse
gaaaaagaagctttgatcaa

SEQ ID NO: 842586 - DNA, 20 bp, mouse
ggagggtgagcggaaatcag

SEQ ID NO: 842587 - DNA, 20 bp, mouse
gcaagcctctggtgatggaa

SEQ ID NO: 842588 - DNA, 20 bp, mouse
gcggaaatcagtggttccgg

SEQ ID NO: 842589 - DNA, 20 bp, mouse
gaaacaagtgacaggtgttt

SEQ ID NO: 842590 - DNA, 20 bp, mouse
ggggctgcccatggggacta

SEQ ID NO: 842591 - DNA, 20 bp, mouse
ggagcggaaatcagtggttc

SEQ ID NO: 842592 - DNA, 20 bp, mouse
gagaggcttgcccactgctg

SEQ ID NO: 842593 - DNA, 20 bp, mouse
gctttagcagggaaagataa

SEQ ID NO: 842594 - DNA, 20 bp, mouse
gaacagctggcattcactga

SEQ ID NO: 842595 - DNA, 20 bp, mouse
gaattgctggtgatcatgtg

SEQ ID NO: 842596 - DNA, 20 bp, mouse
gaataggaggcggcccgaaa

SEQ ID NO: 842597 - DNA, 20 bp, mouse
gctggggcggggcgatggaa

SEQ ID NO: 842598 - DNA, 20 bp, mouse
gtacttctccggcccggcag

SEQ ID NO: 842599 - DNA, 20 bp, mouse
gcccagctctggggtgccaa

SEQ ID NO: 842600 - DNA, 20 bp, mouse
ggaaggggcggggctcgaga

SEQ ID NO: 842601 - DNA, 20 bp, mouse
ggggcgctacggatcctgag

SEQ ID NO: 842602 - DNA, 20 bp, mouse
gcggagaagtagcggggcct

SEQ ID NO: 842603 - DNA, 20 bp, mouse
gaagtaggcggggtgacgtg

SEQ ID NO: 842604 - DNA, 20 bp, mouse
gccgggccggagaagtagcg

SEQ ID NO: 842605 - DNA, 20 bp, mouse
ggcctcggagcgccggaggg

SEQ ID NO: 842606 - DNA, 20 bp, mouse
gcggctgtgctagggaaata

SEQ ID NO: 842607 - DNA, 20 bp, mouse
gctagggaaataggggtcag

SEQ ID NO: 842608 - DNA, 20 bp, mouse
ggagacgcacactcaagtgc

SEQ ID NO: 842609 - DNA, 20 bp, mouse
gaggtcttcctaagtgtctc

SEQ ID NO: 842610 - DNA, 20 bp, mouse
gacccctttacctggaggcg

SEQ ID NO: 842611 - DNA, 20 bp, mouse
gcaagtgctggactagacca

SEQ ID NO: 842612 - DNA, 20 bp, mouse
ggccccgcctccaggtaaag

SEQ ID NO: 842613 - DNA, 20 bp, mouse
gagggacggtcctaaccctg

SEQ ID NO: 842614 - DNA, 20 bp, mouse
gacttgagtgtgcgtctcgt

SEQ ID NO: 842615 - DNA, 20 bp, mouse
gaggaagacctccctctccc

SEQ ID NO: 842616 - DNA, 20 bp, mouse
gccccgctccgtcccagaaa

SEQ ID NO: 842617 - DNA, 20 bp, mouse
gtaatccggcgggtggggag

SEQ ID NO: 842618 - DNA, 20 bp, mouse
gcgcccgaggtctctgggaa

SEQ ID NO: 842619 - DNA, 20 bp, mouse
ggccgccgcccgaggtctct

SEQ ID NO: 842620 - DNA, 20 bp, mouse
gccagaaagggttaatccgg

SEQ ID NO: 842621 - DNA, 20 bp, mouse
gggtggaggggtgaagaaac

SEQ ID NO: 842622 - DNA, 20 bp, mouse
gaggctgctccaatccgggc

SEQ ID NO: 842623 - DNA, 20 bp, mouse
gagggttaatccggcgggtg

SEQ ID NO: 842624 - DNA, 20 bp, mouse
gtgagacgcaaaactggaaa

SEQ ID NO: 842625 - DNA, 20 bp, mouse
gaaccctttctgggacggag

SEQ ID NO: 842626 - DNA, 20 bp, mouse
gcactccgggccaggggatg

SEQ ID NO: 842627 - DNA, 20 bp, mouse
ggcccaccaccgcaccactc

SEQ ID NO: 842628 - DNA, 20 bp, mouse
ggcccggagtggtgcggtgg

SEQ ID NO: 842629 - DNA, 20 bp, mouse
gcccctggcccggagtggtg

SEQ ID NO: 842630 - DNA, 20 bp, mouse
gtgtcctcatcctcatcccc

SEQ ID NO: 842631 - DNA, 20 bp, mouse
gctggcccggagtggtgcgg

SEQ ID NO: 842632 - DNA, 20 bp, mouse
ggaggcaaaggtcattctcg

SEQ ID NO: 842633 - DNA, 20 bp, mouse
ggcgctgcagtcaggtatgt

SEQ ID NO: 842634 - DNA, 20 bp, mouse
gccgggaggcaggcacgctg

SEQ ID NO: 842635 - DNA, 20 bp, mouse
gcttgccgcacggccttgtg

SEQ ID NO: 842636 - DNA, 20 bp, mouse
gcccacaagctccacttctg

SEQ ID NO: 842637 - DNA, 20 bp, mouse
ggcttctcccacttggactc

SEQ ID NO: 842638 - DNA, 20 bp, mouse
gggaagccgggatgccactg

SEQ ID NO: 842639 - DNA, 20 bp, mouse
gtctccttgggcacggacgt

SEQ ID NO: 842640 - DNA, 20 bp, mouse
gaagtggagcttgtgggccc

SEQ ID NO: 842641 - DNA, 20 bp, mouse
gagccacggctgaaacatat

SEQ ID NO: 842642 - DNA, 20 bp, mouse
gagcttgtgggccctggcag

SEQ ID NO: 842643 - DNA, 20 bp, mouse
ggatgccactgggggagagt

SEQ ID NO: 842644 - DNA, 20 bp, mouse
ggccccatatgtttcagccg

SEQ ID NO: 842645 - DNA, 20 bp, mouse
gactcagcctgagtccaagt

SEQ ID NO: 842646 - DNA, 20 bp, mouse
gcaggatacgcacccctctg

SEQ ID NO: 842647 - DNA, 20 bp, mouse
gtggctgtagagggagaagc

SEQ ID NO: 842648 - DNA, 20 bp, mouse
gcctgctctggagacattgg

SEQ ID NO: 842649 - DNA, 20 bp, mouse
gtccggaagatctatcttta

SEQ ID NO: 842650 - DNA, 20 bp, mouse
ggcagcttcgagcccccaga

SEQ ID NO: 842651 - DNA, 20 bp, mouse
gggaagcaccctggctgtag

SEQ ID NO: 842652 - DNA, 20 bp, mouse
gccagagcaggaatagtcag

SEQ ID NO: 842653 - DNA, 20 bp, mouse
gtatcctgactttgtgtccc

SEQ ID NO: 842654 - DNA, 20 bp, mouse
gggtggttctgtgtcgggga

SEQ ID NO: 842655 - DNA, 20 bp, mouse
gttctcttctcaagtagaga

SEQ ID NO: 842656 - DNA, 20 bp, mouse
ggttacagaggccacgccag

SEQ ID NO: 842657 - DNA, 20 bp, mouse
ggaagagaactgccaggtag

SEQ ID NO: 842658 - DNA, 20 bp, mouse
ggaaggagctaaggacagac

SEQ ID NO: 842659 - DNA, 20 bp, mouse
gtgtgtctctgcccctggcg

SEQ ID NO: 842660 - DNA, 20 bp, mouse
gtccaagtttgaaaccagat

SEQ ID NO: 842661 - DNA, 20 bp, mouse
ggaactatagctgccgagcc

SEQ ID NO: 842662 - DNA, 20 bp, mouse
gtagctccttctgttatctc

SEQ ID NO: 842663 - DNA, 20 bp, mouse
gatctctggagtttttaggc

SEQ ID NO: 842664 - DNA, 20 bp, mouse
gaatgcttccttaggcaggg

SEQ ID NO: 842665 - DNA, 20 bp, mouse
gtgttatctctggagttttt

SEQ ID NO: 842666 - DNA, 20 bp, mouse
gcaccctcccagtggaaatc

SEQ ID NO: 842667 - DNA, 20 bp, mouse
gataaggaagttgggagttg

SEQ ID NO: 842668 - DNA, 20 bp, mouse
gtggagccccagatttccac

SEQ ID NO: 842669 - DNA, 20 bp, mouse
gtctcggcttacctgtgttt

SEQ ID NO: 842670 - DNA, 20 bp, mouse
gtgcacgtcacagagatgac

SEQ ID NO: 842671 - DNA, 20 bp, mouse
ggcaagttgcaagggcagga

SEQ ID NO: 842672 - DNA, 20 bp, mouse
gcactgggagggtgagcggg

SEQ ID NO: 842673 - DNA, 20 bp, mouse
gagaaggaggtgactagagg

SEQ ID NO: 842674 - DNA, 20 bp, mouse
gccccagatttccactggga

SEQ ID NO: 842675 - DNA, 20 bp, mouse
ggcaagcagagaaggtggtt

SEQ ID NO: 842676 - DNA, 20 bp, mouse
ggggctttgggagtgacgcg

SEQ ID NO: 842677 - DNA, 20 bp, mouse
gggagtgacgcgcggctggg

SEQ ID NO: 842678 - DNA, 20 bp, mouse
gtctccaaagagctgctagt

SEQ ID NO: 842679 - DNA, 20 bp, mouse
gtgcccagaggacacacaga

SEQ ID NO: 842680 - DNA, 20 bp, mouse
gcaccacgctgcggggacgc

SEQ ID NO: 842681 - DNA, 20 bp, mouse
ggacaaaaggcaccacgctg

SEQ ID NO: 842682 - DNA, 20 bp, mouse
gtcagatcgcgcttattcaa

SEQ ID NO: 842683 - DNA, 20 bp, mouse
gatcagaggtgatgtggcca

SEQ ID NO: 842684 - DNA, 20 bp, mouse
gaagagctgctagtgggact

SEQ ID NO: 842685 - DNA, 20 bp, mouse
ggtgtcctctgggcataatc

SEQ ID NO: 842686 - DNA, 20 bp, mouse
gtctgccccgggaatagaag

SEQ ID NO: 842687 - DNA, 20 bp, mouse
ggaaacgcctcctcacccgg

SEQ ID NO: 842688 - DNA, 20 bp, mouse
gcggcccacgcccccgggtg

SEQ ID NO: 842689 - DNA, 20 bp, mouse
gaacccctaggtccccccag

SEQ ID NO: 842690 - DNA, 20 bp, mouse
ggagcctctggggggaccta

SEQ ID NO: 842691 - DNA, 20 bp, mouse
gggagacttgaaggggtaag

SEQ ID NO: 842692 - DNA, 20 bp, mouse
gagggggaggggagacttga

SEQ ID NO: 842693 - DNA, 20 bp, mouse
gtctgagactggagcctctg

SEQ ID NO: 842694 - DNA, 20 bp, mouse
ggggcggagcgcgggcttcg

SEQ ID NO: 842695 - DNA, 20 bp, mouse
gaaacccgggtgtggtgacg

SEQ ID NO: 842696 - DNA, 20 bp, mouse
gctcccgatgcctgcatctg

SEQ ID NO: 842697 - DNA, 20 bp, mouse
gggcggggttagtggcccgc

SEQ ID NO: 842698 - DNA, 20 bp, mouse
gcacttgagtgcaagcctgc

SEQ ID NO: 842699 - DNA, 20 bp, mouse
gttcccgtggcatggtggtc

SEQ ID NO: 842700 - DNA, 20 bp, mouse
gggtgctacctgccaggagg

SEQ ID NO: 842701 - DNA, 20 bp, mouse
ggctctagatcactcttgca

SEQ ID NO: 842702 - DNA, 20 bp, mouse
gtagagcctctctcttcccg

SEQ ID NO: 842703 - DNA, 20 bp, mouse
gcggcagccttggtaagtca

SEQ ID NO: 842704 - DNA, 20 bp, mouse
gccatgccacgggaagagag

SEQ ID NO: 842705 - DNA, 20 bp, mouse
gatctgtgggcaagaggggt

SEQ ID NO: 842706 - DNA, 20 bp, mouse
ggacctggggctctttaatg

SEQ ID NO: 842707 - DNA, 20 bp, mouse
gaagaggagagctaccttgg

SEQ ID NO: 842708 - DNA, 20 bp, mouse
ggctcctttgagctttcaag

SEQ ID NO: 842709 - DNA, 20 bp, mouse
gtgacaagaggcaggctgcg

SEQ ID NO: 842710 - DNA, 20 bp, mouse
gccaaaggacaaggtctctt

SEQ ID NO: 842711 - DNA, 20 bp, mouse
gggacaaggtctcttaggac

SEQ ID NO: 842712 - DNA, 20 bp, mouse
gttcaagaggagagctacct

SEQ ID NO: 842713 - DNA, 20 bp, mouse
ggaccagtgagttccagatc

SEQ ID NO: 842714 - DNA, 20 bp, mouse
gagctaccttggtggccagg

SEQ ID NO: 842715 - DNA, 20 bp, mouse
ggagagctaccttggtggcc

SEQ ID NO: 842716 - DNA, 20 bp, mouse
gcagaacccgcgggagtcct

SEQ ID NO: 842717 - DNA, 20 bp, mouse
gggagtcctcggactggaaa

SEQ ID NO: 842718 - DNA, 20 bp, mouse
gggactggaaagggcggggt

SEQ ID NO: 842719 - DNA, 20 bp, mouse
gggggcggggctctgagatc

SEQ ID NO: 842720 - DNA, 20 bp, mouse
gacgccgcgccccgtcagtc

SEQ ID NO: 842721 - DNA, 20 bp, mouse
ggaaagggcggggtgggacg

SEQ ID NO: 842722 - DNA, 20 bp, mouse
gcgggcccaaacttccgcag

SEQ ID NO: 842723 - DNA, 20 bp, mouse
gcccgcgggagtcctcggac

SEQ ID NO: 842724 - DNA, 20 bp, mouse
gtcctcggactggaaagggc

SEQ ID NO: 842725 - DNA, 20 bp, mouse
gctagtcgatacctgactga

SEQ ID NO: 842726 - DNA, 20 bp, mouse
gtccggacgctcacacccgt

SEQ ID NO: 842727 - DNA, 20 bp, mouse
ggctccggtgatttaatgat

SEQ ID NO: 842728 - DNA, 20 bp, mouse
gagcgtccggaagaacagaa

SEQ ID NO: 842729 - DNA, 20 bp, mouse
gcatgctcagaagcaatctt

SEQ ID NO: 842730 - DNA, 20 bp, mouse
gctgtgggaagaggaggcgt

SEQ ID NO: 842731 - DNA, 20 bp, mouse
gaggaaataaaattgaccta

SEQ ID NO: 842732 - DNA, 20 bp, mouse
gacctacgggtgtgagcgtc

SEQ ID NO: 842733 - DNA, 20 bp, mouse
ggaaagtaaggaagtcactc

SEQ ID NO: 842734 - DNA, 20 bp, mouse
ggcgtcgccatctttactgt

SEQ ID NO: 842735 - DNA, 20 bp, mouse
gcggaagtcgttctctgagc

SEQ ID NO: 842736 - DNA, 20 bp, mouse
gtacggaggcctgaagtcag

SEQ ID NO: 842737 - DNA, 20 bp, mouse
gagggcgagtgtccgtggat

SEQ ID NO: 842738 - DNA, 20 bp, mouse
gagaggctcgccggaagtga

SEQ ID NO: 842739 - DNA, 20 bp, mouse
gagaagagggcgagtgtccg

SEQ ID NO: 842740 - DNA, 20 bp, mouse
ggagacacggacagccccgg

SEQ ID NO: 842741 - DNA, 20 bp, mouse
gtctccccagcccccagata

SEQ ID NO: 842742 - DNA, 20 bp, mouse
gaaaacagaaagtcatggga

SEQ ID NO: 842743 - DNA, 20 bp, mouse
gaaagtcatgggaaggcctg

SEQ ID NO: 842744 - DNA, 20 bp, mouse
gacggaacaccgcaggggat

SEQ ID NO: 842745 - DNA, 20 bp, mouse
gtgacctcccggcccatcca

SEQ ID NO: 842746 - DNA, 20 bp, mouse
gagggcggaagatcatttga

SEQ ID NO: 842747 - DNA, 20 bp, mouse
ggcaggccacgcccagctga

SEQ ID NO: 842748 - DNA, 20 bp, mouse
gcctctgcgcggtccgtccc

SEQ ID NO: 842749 - DNA, 20 bp, mouse
gggccacgcccagctgaggg

SEQ ID NO: 842750 - DNA, 20 bp, mouse
gaaacaggaaccttgcaaaa

SEQ ID NO: 842751 - DNA, 20 bp, mouse
gttaggaagccgcttcccgc

SEQ ID NO: 842752 - DNA, 20 bp, mouse
ggtccgtcccggggtgcctg

SEQ ID NO: 842753 - DNA, 20 bp, mouse
gtgccgcaggcaccccggga

SEQ ID NO: 842754 - DNA, 20 bp, mouse
ggttgctgggagtgaaacta

SEQ ID NO: 842755 - DNA, 20 bp, mouse
gcagctgagggcggagagct

SEQ ID NO: 842756 - DNA, 20 bp, mouse
gggagctcacaggctacaga

SEQ ID NO: 842757 - DNA, 20 bp, mouse
ggctggttacggcggaagta

SEQ ID NO: 842758 - DNA, 20 bp, mouse
gggacgtggcggcggaactg

SEQ ID NO: 842759 - DNA, 20 bp, mouse
gccagccagtggggacctag

SEQ ID NO: 842760 - DNA, 20 bp, mouse
gtcgaagccggacgtggcgg

SEQ ID NO: 842761 - DNA, 20 bp, mouse
gccgccgtaaccagccagtg

SEQ ID NO: 842762 - DNA, 20 bp, mouse
ggcggccgctaggtccccac

SEQ ID NO: 842763 - DNA, 20 bp, mouse
gaagtgtaaatggtagagag

SEQ ID NO: 842764 - DNA, 20 bp, mouse
gccgcgctggagggcgacgt

SEQ ID NO: 842765 - DNA, 20 bp, mouse
ggtggcggcggaactggggc

SEQ ID NO: 842766 - DNA, 20 bp, mouse
gaagatggggagcccctagt

SEQ ID NO: 842767 - DNA, 20 bp, mouse
gggaacagaagcctcgggat

SEQ ID NO: 842768 - DNA, 20 bp, mouse
ggggatgaggtcagagacgc

SEQ ID NO: 842769 - DNA, 20 bp, mouse
gtgcaacacgcgggaagttg

SEQ ID NO: 842770 - DNA, 20 bp, mouse
gcacgcgggaagttggggcg

SEQ ID NO: 842771 - DNA, 20 bp, mouse
gccctagtgggaggaagtcg

SEQ ID NO: 842772 - DNA, 20 bp, mouse
gtagtgggaggaagtcgggg

SEQ ID NO: 842773 - DNA, 20 bp, mouse
gtcagtgctcaccaatcccg

SEQ ID NO: 842774 - DNA, 20 bp, mouse
gtggcggcccagaggggcga

SEQ ID NO: 842775 - DNA, 20 bp, mouse
gggctgtaacagtttattgg

SEQ ID NO: 842776 - DNA, 20 bp, mouse
gccgatggcggggaaacaga

SEQ ID NO: 842777 - DNA, 20 bp, mouse
ggcgggttcgaacgttccga

SEQ ID NO: 842778 - DNA, 20 bp, mouse
gcacggcgcgtccacgaaaa

SEQ ID NO: 842779 - DNA, 20 bp, mouse
ggtcacgcccgccgactgcg

SEQ ID NO: 842780 - DNA, 20 bp, mouse
gccgactgcggggctccgac

SEQ ID NO: 842781 - DNA, 20 bp, mouse
ggggcctacagtagcacgtt

SEQ ID NO: 842782 - DNA, 20 bp, mouse
gtcggcgaatagtttccctg

SEQ ID NO: 842783 - DNA, 20 bp, mouse
gtacagtagcacgttgggaa

SEQ ID NO: 842784 - DNA, 20 bp, mouse
gtgaagtaggcaggtagcta

SEQ ID NO: 842785 - DNA, 20 bp, mouse
gggaaactattcgccgatgg

SEQ ID NO: 842786 - DNA, 20 bp, mouse
ggagcccgagcgcgcggcaa

SEQ ID NO: 842787 - DNA, 20 bp, mouse
gcagcggcagcccaagggtc

SEQ ID NO: 842788 - DNA, 20 bp, mouse
gctcccgtggtccagaccct

SEQ ID NO: 842789 - DNA, 20 bp, mouse
ggggcggcgccctcgcgcct

SEQ ID NO: 842790 - DNA, 20 bp, mouse
gcaccagcgcgcgcacgcta

SEQ ID NO: 842791 - DNA, 20 bp, mouse
gcggccgttgccgcgcgctc

SEQ ID NO: 842792 - DNA, 20 bp, mouse
gtgaccgcgctgcgcgctct

SEQ ID NO: 842793 - DNA, 20 bp, mouse
gcacgggcaccgggctccag

SEQ ID NO: 842794 - DNA, 20 bp, mouse
gaaagggacgacggcgacgg

SEQ ID NO: 842795 - DNA, 20 bp, mouse
gtctgccggcgtccgaatcc

SEQ ID NO: 842796 - DNA, 20 bp, mouse
gtggacccagagcggcagag

SEQ ID NO: 842797 - DNA, 20 bp, mouse
ggattcgccctgctcctcaa

SEQ ID NO: 842798 - DNA, 20 bp, mouse
gaaatagaggcctgcccggg

SEQ ID NO: 842799 - DNA, 20 bp, mouse
gccgccccctctgccgctct

SEQ ID NO: 842800 - DNA, 20 bp, mouse
gtgggtccagaaggaaatag

SEQ ID NO: 842801 - DNA, 20 bp, mouse
ggcggagcccgtgacttagc

SEQ ID NO: 842802 - DNA, 20 bp, mouse
gaccacgccccttgaggagc

SEQ ID NO: 842803 - DNA, 20 bp, mouse
ggctcgggctccaggataag

SEQ ID NO: 842804 - DNA, 20 bp, mouse
gcagacaaggatgaccaaca

SEQ ID NO: 842805 - DNA, 20 bp, mouse
gaggccctccatcagagtcc

SEQ ID NO: 842806 - DNA, 20 bp, mouse
gagctggctcaaccaggaga

SEQ ID NO: 842807 - DNA, 20 bp, mouse
ggaggcgagctggctcaacc

SEQ ID NO: 842808 - DNA, 20 bp, mouse
gtggccgctgcgggactctc

SEQ ID NO: 842809 - DNA, 20 bp, mouse
ggaaggggcgggtcttatgc

SEQ ID NO: 842810 - DNA, 20 bp, mouse
gcccgcagcggccatgaaac

SEQ ID NO: 842811 - DNA, 20 bp, mouse
gttgccagagagtcccgcag

SEQ ID NO: 842812 - DNA, 20 bp, mouse
gcggctatcgagtgcggcgg

SEQ ID NO: 842813 - DNA, 20 bp, mouse
gaggcgcagtccaaccgccc

SEQ ID NO: 842814 - DNA, 20 bp, mouse
gctaggaagcggaagtgcag

SEQ ID NO: 842815 - DNA, 20 bp, mouse
gtaagacccgccccttctct

SEQ ID NO: 842816 - DNA, 20 bp, mouse
ggaccctccgaaaatcctcg

SEQ ID NO: 842817 - DNA, 20 bp, mouse
ggcggccctgcgtaggcaag

SEQ ID NO: 842818 - DNA, 20 bp, mouse
gccgccgcgaggattttcgg

SEQ ID NO: 842819 - DNA, 20 bp, mouse
ggggccgccgcgaggatttt

SEQ ID NO: 842820 - DNA, 20 bp, mouse
gaggtccaggggcgcagtgg

SEQ ID NO: 842821 - DNA, 20 bp, mouse
ggggtccgccgccgggtctg

SEQ ID NO: 842822 - DNA, 20 bp, mouse
gcgtggccagcgaggtccag

SEQ ID NO: 842823 - DNA, 20 bp, mouse
ggctccagctagcggtagat

SEQ ID NO: 842824 - DNA, 20 bp, mouse
gggtcagggaccctgggtga

SEQ ID NO: 842825 - DNA, 20 bp, mouse
gacccagggtccctgaccag

SEQ ID NO: 842826 - DNA, 20 bp, mouse
ggcgccccgtgtagatcggg

SEQ ID NO: 842827 - DNA, 20 bp, mouse
ggcaccccgaggcccctcgc

SEQ ID NO: 842828 - DNA, 20 bp, mouse
ggggcctcggggtgcggccg

SEQ ID NO: 842829 - DNA, 20 bp, mouse
gctggcgccccgtgtagatc

SEQ ID NO: 842830 - DNA, 20 bp, mouse
gggcccccggccgcaccccg

SEQ ID NO: 842831 - DNA, 20 bp, mouse
ggaggcgggcgcagaagcga

SEQ ID NO: 842832 - DNA, 20 bp, mouse
gggagcggctgcgtagggga

SEQ ID NO: 842833 - DNA, 20 bp, mouse
gaggcggggaggccggcgaa

SEQ ID NO: 842834 - DNA, 20 bp, mouse
gcccgcctcccgatctacac

SEQ ID NO: 842835 - DNA, 20 bp, mouse
ggcggcagtcctgccctaga

SEQ ID NO: 842836 - DNA, 20 bp, mouse
gtagctggcccaaccatctc

SEQ ID NO: 842837 - DNA, 20 bp, mouse
gaggaaccctgagtgaatga

SEQ ID NO: 842838 - DNA, 20 bp, mouse
gcaaaaagggttaacagaga

SEQ ID NO: 842839 - DNA, 20 bp, mouse
gaaacatgctacttagagga

SEQ ID NO: 842840 - DNA, 20 bp, mouse
gcattgacagctttagtcat

SEQ ID NO: 842841 - DNA, 20 bp, mouse
gagctcctcccactatgtca

SEQ ID NO: 842842 - DNA, 20 bp, mouse
gttgttttccatgacatagt

SEQ ID NO: 842843 - DNA, 20 bp, mouse
gaaccctgagtgaatgatgg

SEQ ID NO: 842844 - DNA, 20 bp, mouse
gttttccatgacatagtggg

SEQ ID NO: 842845 - DNA, 20 bp, mouse
gcaatgagctggcaagaccg

SEQ ID NO: 842846 - DNA, 20 bp, mouse
gagtgagagtcactaagaag

SEQ ID NO: 842847 - DNA, 20 bp, mouse
ggtgctctcctgacaaaaaa

SEQ ID NO: 842848 - DNA, 20 bp, mouse
gagacatcatgatctttcct

SEQ ID NO: 842849 - DNA, 20 bp, mouse
ggtaagacactgcctaaaag

SEQ ID NO: 842850 - DNA, 20 bp, mouse
gtattagacctttttttgtc

SEQ ID NO: 842851 - DNA, 20 bp, mouse
gcccagtctcaatgattccc

SEQ ID NO: 842852 - DNA, 20 bp, mouse
gctgacaggtcctaagcctt

SEQ ID NO: 842853 - DNA, 20 bp, mouse
gagagctggtttaaaagtag

SEQ ID NO: 842854 - DNA, 20 bp, mouse
ggagttatgaaacaatgttt

SEQ ID NO: 842855 - DNA, 20 bp, mouse
gtcaaagcaacatagagacc

SEQ ID NO: 842856 - DNA, 20 bp, mouse
gaatttgaggcccaggtcgg

SEQ ID NO: 842857 - DNA, 20 bp, mouse
gtagtccatgcttactacat

SEQ ID NO: 842858 - DNA, 20 bp, mouse
ggtctgacatggattgtaga

SEQ ID NO: 842859 - DNA, 20 bp, mouse
gagaatgcaggacaccccag

SEQ ID NO: 842860 - DNA, 20 bp, mouse
ggcaactgttcatcacatgt

SEQ ID NO: 842861 - DNA, 20 bp, mouse
gggatcctgcacttagttaa

SEQ ID NO: 842862 - DNA, 20 bp, mouse
gggagagaagccacgctctg

SEQ ID NO: 842863 - DNA, 20 bp, mouse
gctcaccctgagtcagttcc

SEQ ID NO: 842864 - DNA, 20 bp, mouse
gggagaattccgactttatc

SEQ ID NO: 842865 - DNA, 20 bp, mouse
gttctcctatgtagtaagca

SEQ ID NO: 842866 - DNA, 20 bp, mouse
gaggccagcctgttagaatg

SEQ ID NO: 842867 - DNA, 20 bp, mouse
gtgaggccatggaatgaaat

SEQ ID NO: 842868 - DNA, 20 bp, mouse
gcccagtggcgtgacaaggt

SEQ ID NO: 842869 - DNA, 20 bp, mouse
gctgctaaccacattctaac

SEQ ID NO: 842870 - DNA, 20 bp, mouse
ggccacccagtggcgtgaca

SEQ ID NO: 842871 - DNA, 20 bp, mouse
gagagttctgccagttttct

SEQ ID NO: 842872 - DNA, 20 bp, mouse
gaaaggttgtccagcattat

SEQ ID NO: 842873 - DNA, 20 bp, mouse
gtaaaggataaatctgccct

SEQ ID NO: 842874 - DNA, 20 bp, mouse
gtgtttctctcctagaaaac

SEQ ID NO: 842875 - DNA, 20 bp, mouse
gtgctccttgtggatgtgga

SEQ ID NO: 842876 - DNA, 20 bp, mouse
gggaaggattagcccattaa

SEQ ID NO: 842877 - DNA, 20 bp, mouse
ggcccaggtcagctccttcc

SEQ ID NO: 842878 - DNA, 20 bp, mouse
gaacagtagcaaagactcat

SEQ ID NO: 842879 - DNA, 20 bp, mouse
gtgtgagtttagcggagaaa

SEQ ID NO: 842880 - DNA, 20 bp, mouse
ggggtcccaccctgtaagat

SEQ ID NO: 842881 - DNA, 20 bp, mouse
gctgggccttgtgagtttag

SEQ ID NO: 842882 - DNA, 20 bp, mouse
gtaaaggatgccaatcttac

SEQ ID NO: 842883 - DNA, 20 bp, mouse
ggatgccaatcttacagggt

SEQ ID NO: 842884 - DNA, 20 bp, mouse
gactatgcaaccaagcatgc

SEQ ID NO: 842885 - DNA, 20 bp, mouse
ggaaactacactaagcttag

SEQ ID NO: 842886 - DNA, 20 bp, mouse
gcatttgagcctacatgcca

SEQ ID NO: 842887 - DNA, 20 bp, mouse
gcactgtggtgccaagatta

SEQ ID NO: 842888 - DNA, 20 bp, mouse
gacggggatggttgatgagt

SEQ ID NO: 842889 - DNA, 20 bp, mouse
gcatcagcagtgtggggata

SEQ ID NO: 842890 - DNA, 20 bp, mouse
gccaagattaaggcaagccc

SEQ ID NO: 842891 - DNA, 20 bp, mouse
ggcaaatggcagatatgacg

SEQ ID NO: 842892 - DNA, 20 bp, mouse
gagtggagcatcagcagtgt

SEQ ID NO: 842893 - DNA, 20 bp, mouse
gaatgtgcatatatgtgaca

SEQ ID NO: 842894 - DNA, 20 bp, mouse
gatggcagatatgacgggga

SEQ ID NO: 842895 - DNA, 20 bp, mouse
gcatatatgtgacaaggtct

SEQ ID NO: 842896 - DNA, 20 bp, mouse
ggtcagaaggtcttctcctc

SEQ ID NO: 842897 - DNA, 20 bp, mouse
gaccttctgaccctttttgg

SEQ ID NO: 842898 - DNA, 20 bp, mouse
gaagaccttctgaccctttt

SEQ ID NO: 842899 - DNA, 20 bp, mouse
gccccccaaaaagggtcaga

SEQ ID NO: 842900 - DNA, 20 bp, mouse
gggaaatacactaaacccta

SEQ ID NO: 842901 - DNA, 20 bp, mouse
gtgtgtgctcacagccgttt

SEQ ID NO: 842902 - DNA, 20 bp, mouse
gagagagaaatctacgcagg

SEQ ID NO: 842903 - DNA, 20 bp, mouse
gtgattctaccccccaaaaa

SEQ ID NO: 842904 - DNA, 20 bp, mouse
gcaaagcagcttacatttct

SEQ ID NO: 842905 - DNA, 20 bp, mouse
gtctgcttccaaggcaaaag

SEQ ID NO: 842906 - DNA, 20 bp, mouse
gtgcccaagaaaagggtcat

SEQ ID NO: 842907 - DNA, 20 bp, mouse
gaaagcctccccccagagga

SEQ ID NO: 842908 - DNA, 20 bp, mouse
gggcctatgacccttttctt

SEQ ID NO: 842909 - DNA, 20 bp, mouse
gagtccacgccctcctctgg

SEQ ID NO: 842910 - DNA, 20 bp, mouse
gctagaaagcctccccccag

SEQ ID NO: 842911 - DNA, 20 bp, mouse
gcaaaagtcagtcattgtca

SEQ ID NO: 842912 - DNA, 20 bp, mouse
ggaacctccccataggcctt

SEQ ID NO: 842913 - DNA, 20 bp, mouse
ggtgagtccacgccctcctc

SEQ ID NO: 842914 - DNA, 20 bp, mouse
gctccccccagaggagggcg

SEQ ID NO: 842915 - DNA, 20 bp, mouse
ggatcatgtcaaggacctgg

SEQ ID NO: 842916 - DNA, 20 bp, mouse
ggtcttaaatatctttcata

SEQ ID NO: 842917 - DNA, 20 bp, mouse
gaaaactgtttctgtaatag

SEQ ID NO: 842918 - DNA, 20 bp, mouse
gttcaatgagttatgaaaaa

SEQ ID NO: 842919 - DNA, 20 bp, mouse
gacggttatgaaatatgctc

SEQ ID NO: 842920 - DNA, 20 bp, mouse
ggaaatgggccactccctaa

SEQ ID NO: 842921 - DNA, 20 bp, mouse
gttgttggaaaggacatgcc

SEQ ID NO: 842922 - DNA, 20 bp, mouse
gtggtctgcagataaaaaaa

SEQ ID NO: 842923 - DNA, 20 bp, mouse
gctagaggtcacacagaaat

SEQ ID NO: 842924 - DNA, 20 bp, mouse
gcctaaaggacacattttgt

SEQ ID NO: 842925 - DNA, 20 bp, mouse
gacctactgcagtggacaca

SEQ ID NO: 842926 - DNA, 20 bp, mouse
gtagacaaggtgataggatg

SEQ ID NO: 842927 - DNA, 20 bp, mouse
gtcttgctagacaaggtgat

SEQ ID NO: 842928 - DNA, 20 bp, mouse
gttatagtagacagcatagg

SEQ ID NO: 842929 - DNA, 20 bp, mouse
gaaaggtgtaataggtaggt

SEQ ID NO: 842930 - DNA, 20 bp, mouse
gtgtaataggtaggttggtt

SEQ ID NO: 842931 - DNA, 20 bp, mouse
gaacaaaaggtgtaataggt

SEQ ID NO: 842932 - DNA, 20 bp, mouse
gcttcaacaaaaggtgtaat

SEQ ID NO: 842933 - DNA, 20 bp, mouse
gatgtggaatatgatcttga

SEQ ID NO: 842934 - DNA, 20 bp, mouse
gttaattggttcatacagta

SEQ ID NO: 842935 - DNA, 20 bp, mouse
gaaaggtgacacatttaaca

SEQ ID NO: 842936 - DNA, 20 bp, mouse
gccagctattcataaggaaa

SEQ ID NO: 842937 - DNA, 20 bp, mouse
gcaaggggcctcgggtgact

SEQ ID NO: 842938 - DNA, 20 bp, mouse
gaagatggcctagtcacccg

SEQ ID NO: 842939 - DNA, 20 bp, mouse
ggaatatccagctattcata

SEQ ID NO: 842940 - DNA, 20 bp, mouse
gtctatataatattagtcta

SEQ ID NO: 842941 - DNA, 20 bp, mouse
gagtgggaatggttcggtag

SEQ ID NO: 842942 - DNA, 20 bp, mouse
gcaacacagggcccccatgg

SEQ ID NO: 842943 - DNA, 20 bp, mouse
gttgcaagaccaaggggcct

SEQ ID NO: 842944 - DNA, 20 bp, mouse
gttttaaacttacaaagaca

SEQ ID NO: 842945 - DNA, 20 bp, mouse
gttagtctatggtgttttat

SEQ ID NO: 842946 - DNA, 20 bp, mouse
gttgtagctcaatactatca

SEQ ID NO: 842947 - DNA, 20 bp, mouse
gactgactagatgagtctga

SEQ ID NO: 842948 - DNA, 20 bp, mouse
gactcatctagtcagtgatg

SEQ ID NO: 842949 - DNA, 20 bp, mouse
gttattttcccattcaaagg

SEQ ID NO: 842950 - DNA, 20 bp, mouse
gtttatgaaatttaggtaaa

SEQ ID NO: 842951 - DNA, 20 bp, mouse
gcacatggaacatgagctca

SEQ ID NO: 842952 - DNA, 20 bp, mouse
gcttcgttccacctttgaat

SEQ ID NO: 842953 - DNA, 20 bp, mouse
gtaacatgatatgtactcac

SEQ ID NO: 842954 - DNA, 20 bp, mouse
gtggttgggttacgtcactc

SEQ ID NO: 842955 - DNA, 20 bp, mouse
gccttcttcttgagttgcat

SEQ ID NO: 842956 - DNA, 20 bp, mouse
ggagggcaaatgccaaaacc

SEQ ID NO: 842957 - DNA, 20 bp, mouse
ggggtagagatggagctaat

SEQ ID NO: 842958 - DNA, 20 bp, mouse
gcttgaatgtatactgtatt

SEQ ID NO: 842959 - DNA, 20 bp, mouse
gcaagtaagcaggttcttga

SEQ ID NO: 842960 - DNA, 20 bp, mouse
gtttggcatttgccctccag

SEQ ID NO: 842961 - DNA, 20 bp, mouse
gtgactagttacaagtaagc

SEQ ID NO: 842962 - DNA, 20 bp, mouse
gcactaagtagtatggtaac

SEQ ID NO: 842963 - DNA, 20 bp, mouse
gcacatctgcatccaggttt

SEQ ID NO: 842964 - DNA, 20 bp, mouse
gctcccatttctatttgctt

SEQ ID NO: 842965 - DNA, 20 bp, mouse
gatgacaaaacactgaccta

SEQ ID NO: 842966 - DNA, 20 bp, mouse
gttaatgaccagattgaagt

SEQ ID NO: 842967 - DNA, 20 bp, mouse
gtagtacatctggatttcac

SEQ ID NO: 842968 - DNA, 20 bp, mouse
gcctgtaaacaggtttacac

SEQ ID NO: 842969 - DNA, 20 bp, mouse
gccactcagggcagtgtgtt

SEQ ID NO: 842970 - DNA, 20 bp, mouse
gtcagccaccaacttcaatc

SEQ ID NO: 842971 - DNA, 20 bp, mouse
gattcaaaactcctgtaaac

SEQ ID NO: 842972 - DNA, 20 bp, mouse
gcatgatatactgataagtt

SEQ ID NO: 842973 - DNA, 20 bp, mouse
ggtaactaaggcacactgtc

SEQ ID NO: 842974 - DNA, 20 bp, mouse
gtttgtaaagaagtaaagtt

SEQ ID NO: 842975 - DNA, 20 bp, mouse
gtcttcttagataagaggac

SEQ ID NO: 842976 - DNA, 20 bp, mouse
ggactctggggtattcaaag

SEQ ID NO: 842977 - DNA, 20 bp, mouse
gtatccagggcaacagataa

SEQ ID NO: 842978 - DNA, 20 bp, mouse
gtgactgtaacaggtatcct

SEQ ID NO: 842979 - DNA, 20 bp, mouse
gcaaataattgcagcagttg

SEQ ID NO: 842980 - DNA, 20 bp, mouse
gggggcaggtggagtttgag

SEQ ID NO: 842981 - DNA, 20 bp, mouse
gggtggaaggctcaggctag

SEQ ID NO: 842982 - DNA, 20 bp, mouse
ggaaatgaacattactgtgt

SEQ ID NO: 842983 - DNA, 20 bp, mouse
gttgtcatggtggaaggctc

SEQ ID NO: 842984 - DNA, 20 bp, mouse
ggatgatttgtcatggtgga

SEQ ID NO: 842985 - DNA, 20 bp, mouse
gctatggcaacagattccac

SEQ ID NO: 842986 - DNA, 20 bp, mouse
ggtcatgttcaattattaat

SEQ ID NO: 842987 - DNA, 20 bp, mouse
gtttcccaaaaccttagttc

SEQ ID NO: 842988 - DNA, 20 bp, mouse
ggtaaattaataagctttca

SEQ ID NO: 842989 - DNA, 20 bp, mouse
gaattattctgactaaatca

SEQ ID NO: 842990 - DNA, 20 bp, mouse
gaagaccagaactaaggttt

SEQ ID NO: 842991 - DNA, 20 bp, mouse
ggatatgttaacaatagatg

SEQ ID NO: 842992 - DNA, 20 bp, mouse
gtatagcaaatattaaggtt

SEQ ID NO: 842993 - DNA, 20 bp, mouse
gcaggttatagcaaatatta

SEQ ID NO: 842994 - DNA, 20 bp, mouse
ggttaacaatagatggggac

SEQ ID NO: 842995 - DNA, 20 bp, mouse
gtgagtcacgtctcttatga

SEQ ID NO: 842996 - DNA, 20 bp, mouse
gaagagacatatggacctgg

SEQ ID NO: 842997 - DNA, 20 bp, mouse
gtgttttcaaggtcatatag

SEQ ID NO: 842998 - DNA, 20 bp, mouse
gtttaagagacatatggacc

SEQ ID NO: 842999 - DNA, 20 bp, mouse
gtttcccatcaccatagttc

SEQ ID NO: 843000 - DNA, 20 bp, mouse
gtgagtacatattttgtgat

SEQ ID NO: 843001 - DNA, 20 bp, mouse
gaattattctgattcaatca

SEQ ID NO: 843002 - DNA, 20 bp, mouse
gagacattttaagagacata

SEQ ID NO: 843003 - DNA, 20 bp, mouse
ggtaaattaatatgttttca

SEQ ID NO: 843004 - DNA, 20 bp, mouse
gagagaccagccatattatg

SEQ ID NO: 843005 - DNA, 20 bp, mouse
gagtgacctcataatatggc

SEQ ID NO: 843006 - DNA, 20 bp, mouse
ggatcactctcatgtaaaaa

SEQ ID NO: 843007 - DNA, 20 bp, mouse
gcatgccatcataagagaca

SEQ ID NO: 843008 - DNA, 20 bp, mouse
ggtaatgatcatataagatt

SEQ ID NO: 843009 - DNA, 20 bp, mouse
gtcttatatgatcattactg

SEQ ID NO: 843010 - DNA, 20 bp, mouse
gatgactgagtttgaattat

SEQ ID NO: 843011 - DNA, 20 bp, mouse
gacaagagatctttatttct

SEQ ID NO: 843012 - DNA, 20 bp, mouse
ggctatgttaacaatagatg

SEQ ID NO: 843013 - DNA, 20 bp, mouse
gtatagcaaatattaaggtt

SEQ ID NO: 843014 - DNA, 20 bp, mouse
gcaggttatagcaaatatta

SEQ ID NO: 843015 - DNA, 20 bp, mouse
ggttaacaatagatggggac

SEQ ID NO: 843016 - DNA, 20 bp, mouse
gtaggatgcggtcattgaca

SEQ ID NO: 843017 - DNA, 20 bp, mouse
gcccactttagagttttttg

SEQ ID NO: 843018 - DNA, 20 bp, mouse
gagggtgaaacagtatccac

SEQ ID NO: 843019 - DNA, 20 bp, mouse
gtaggcttgtaaaatgtcca

SEQ ID NO: 843020 - DNA, 20 bp, mouse
gatcttgtaagcttgtgact

SEQ ID NO: 843021 - DNA, 20 bp, mouse
gaggaaaatattgtgatttt

SEQ ID NO: 843022 - DNA, 20 bp, mouse
gggcattaggatacagatag

SEQ ID NO: 843023 - DNA, 20 bp, mouse
gacagatagaggagtgatgg

SEQ ID NO: 843024 - DNA, 20 bp, mouse
gcaatgaccgcatcctaaag

SEQ ID NO: 843025 - DNA, 20 bp, mouse
ggagttttttgaggctaaca

SEQ ID NO: 843026 - DNA, 20 bp, mouse
gaggatgatgcaacatcagc

SEQ ID NO: 843027 - DNA, 20 bp, mouse
ggaaaaggccaagggtaaaa

SEQ ID NO: 843028 - DNA, 20 bp, mouse
ggacgatagaaaatagatag

SEQ ID NO: 843029 - DNA, 20 bp, mouse
gtagatagaggagtgtcaga

SEQ ID NO: 843030 - DNA, 20 bp, mouse
ggtgggaatgtagggacctt

SEQ ID NO: 843031 - DNA, 20 bp, mouse
gatcttgtgagcttatgact

SEQ ID NO: 843032 - DNA, 20 bp, mouse
gacttctggaacaattaccc

SEQ ID NO: 843033 - DNA, 20 bp, mouse
gtcactggagattttaaaac

SEQ ID NO: 843034 - DNA, 20 bp, mouse
gtttcttttaactctagtta

SEQ ID NO: 843035 - DNA, 20 bp, mouse
gtcattgacaggatttccca

SEQ ID NO: 843036 - DNA, 20 bp, mouse
gtcagcgcgccactactgag

SEQ ID NO: 843037 - DNA, 20 bp, mouse
ggcgctgcggccccgagggg

SEQ ID NO: 843038 - DNA, 20 bp, mouse
gcgcgtgcgcatcggtgtcc

SEQ ID NO: 843039 - DNA, 20 bp, mouse
gggcgcaggcgcgtctggag

SEQ ID NO: 843040 - DNA, 20 bp, mouse
gcgtcgaggcgcgtgcgcat

SEQ ID NO: 843041 - DNA, 20 bp, mouse
gtgagagacggcttgagggg

SEQ ID NO: 843042 - DNA, 20 bp, mouse
gctccgcggtgccccccctc

SEQ ID NO: 843043 - DNA, 20 bp, mouse
gtagggcaggcgatgctccg

SEQ ID NO: 843044 - DNA, 20 bp, mouse
gaggcgcgctgcggccccga

SEQ ID NO: 843045 - DNA, 20 bp, mouse
gtctggagcggagactttga

SEQ ID NO: 843046 - DNA, 20 bp, mouse
ggggggaaagccaatcctag

SEQ ID NO: 843047 - DNA, 20 bp, mouse
gtggaggccccgcccctctt

SEQ ID NO: 843048 - DNA, 20 bp, mouse
gtgaggtccggggagtcggt

SEQ ID NO: 843049 - DNA, 20 bp, mouse
gcggacccagccggaagtgg

SEQ ID NO: 843050 - DNA, 20 bp, mouse
ggagtcggtcggagcgctgc

SEQ ID NO: 843051 - DNA, 20 bp, mouse
gggaaccaaagtcctgtcct

SEQ ID NO: 843052 - DNA, 20 bp, mouse
ggctgggtccgagtgcactc

SEQ ID NO: 843053 - DNA, 20 bp, mouse
ggtcatggcggcctgaggtc

SEQ ID NO: 843054 - DNA, 20 bp, mouse
gtgccttgaatgcgcaagga

SEQ ID NO: 843055 - DNA, 20 bp, mouse
gagctgccgggtttgggtga

SEQ ID NO: 843056 - DNA, 20 bp, mouse
gtggggcgtccgcatgacta

SEQ ID NO: 843057 - DNA, 20 bp, mouse
gggagacttccaccccaatt

SEQ ID NO: 843058 - DNA, 20 bp, mouse
gagggctcttgattcctgat

SEQ ID NO: 843059 - DNA, 20 bp, mouse
gacttccaccccaattgggt

SEQ ID NO: 843060 - DNA, 20 bp, mouse
gtagtgtggtcagaagtctc

SEQ ID NO: 843061 - DNA, 20 bp, mouse
ggagccctccccacccaatt

SEQ ID NO: 843062 - DNA, 20 bp, mouse
gtaaggatctaccccacccc

SEQ ID NO: 843063 - DNA, 20 bp, mouse
gtaaacctcatagcattcct

SEQ ID NO: 843064 - DNA, 20 bp, mouse
gcacccccggctccgcccaa

SEQ ID NO: 843065 - DNA, 20 bp, mouse
ggggtgcagggtatctggtg

SEQ ID NO: 843066 - DNA, 20 bp, mouse
ggcggggcttacacgctcag

SEQ ID NO: 843067 - DNA, 20 bp, mouse
gaatgccaccatctaccttc

SEQ ID NO: 843068 - DNA, 20 bp, mouse
gcggggctcactcttccaga

SEQ ID NO: 843069 - DNA, 20 bp, mouse
gcgcggcggcacaggcgcaa

SEQ ID NO: 843070 - DNA, 20 bp, mouse
gcacaggcgcaagggatgag

SEQ ID NO: 843071 - DNA, 20 bp, mouse
gtctggagagttcggagtaa

SEQ ID NO: 843072 - DNA, 20 bp, mouse
ggggcttacacgctcagagg

SEQ ID NO: 843073 - DNA, 20 bp, mouse
gcgggagctcagaggcatag

SEQ ID NO: 843074 - DNA, 20 bp, mouse
gagctcagaggcataggggg

SEQ ID NO: 843075 - DNA, 20 bp, mouse
gtggcgagagcgcacggcga

SEQ ID NO: 843076 - DNA, 20 bp, mouse
gaggcacagacaagatgaaa

SEQ ID NO: 843077 - DNA, 20 bp, mouse
gactaggatgtcagcgagag

SEQ ID NO: 843078 - DNA, 20 bp, mouse
ggggcagcggaggacctagt

SEQ ID NO: 843079 - DNA, 20 bp, mouse
ggaaagcccaagtaccaact

SEQ ID NO: 843080 - DNA, 20 bp, mouse
gaactaggaaagggcagcgg

SEQ ID NO: 843081 - DNA, 20 bp, mouse
gcctacttcggactcccact

SEQ ID NO: 843082 - DNA, 20 bp, mouse
gggggcggggagaggagtcg

SEQ ID NO: 843083 - DNA, 20 bp, mouse
gcccaagtaccaactaggaa

SEQ ID NO: 843084 - DNA, 20 bp, mouse
gagcagaaagttgagttcgg

SEQ ID NO: 843085 - DNA, 20 bp, mouse
gggcggagcgagctcgaggt

SEQ ID NO: 843086 - DNA, 20 bp, mouse
gaggtgaccaacgacaacga

SEQ ID NO: 843087 - DNA, 20 bp, mouse
gctcctccgagtaacggctc

SEQ ID NO: 843088 - DNA, 20 bp, mouse
ggggttgggcaggctcgccg

SEQ ID NO: 843089 - DNA, 20 bp, mouse
gctccagagccgttactcgg

SEQ ID NO: 843090 - DNA, 20 bp, mouse
gagcctggggggcgctaata

SEQ ID NO: 843091 - DNA, 20 bp, mouse
gggcctccagagccgttact

SEQ ID NO: 843092 - DNA, 20 bp, mouse
gtggggggcgctaatatggg

SEQ ID NO: 843093 - DNA, 20 bp, mouse
gctggcgtgagcaagaaatg

SEQ ID NO: 843094 - DNA, 20 bp, mouse
gcgccccccaggctgtgcgt

SEQ ID NO: 843095 - DNA, 20 bp, mouse
ggtcacctcgcagtctcctg

SEQ ID NO: 843096 - DNA, 20 bp, mouse
gcgcaggcgcggagccctgt

SEQ ID NO: 843097 - DNA, 20 bp, mouse
ggaactgtgtgagcatacag

SEQ ID NO: 843098 - DNA, 20 bp, mouse
gcagcagagcttatttcgaa

SEQ ID NO: 843099 - DNA, 20 bp, mouse
gaaaccaaagaaagccaata

SEQ ID NO: 843100 - DNA, 20 bp, mouse
gggagggcgggtatgattgt

SEQ ID NO: 843101 - DNA, 20 bp, mouse
gcctgagtgctgttaagaga

SEQ ID NO: 843102 - DNA, 20 bp, mouse
gggaccctattggctttctt

SEQ ID NO: 843103 - DNA, 20 bp, mouse
gtgttaagagaggggtttag

SEQ ID NO: 843104 - DNA, 20 bp, mouse
ggggtgtctagggaccctat

SEQ ID NO: 843105 - DNA, 20 bp, mouse
ggtatgctcacacagttcct

SEQ ID NO: 843106 - DNA, 20 bp, mouse
gggaaggaacgcagctgcgc

SEQ ID NO: 843107 - DNA, 20 bp, mouse
gggctggcaggctgacaggt

SEQ ID NO: 843108 - DNA, 20 bp, mouse
ggcaagggagtgcactgcgc

SEQ ID NO: 843109 - DNA, 20 bp, mouse
ggggtggggtgagtgacgag

SEQ ID NO: 843110 - DNA, 20 bp, mouse
ggggtgagtgacgagtggga

SEQ ID NO: 843111 - DNA, 20 bp, mouse
ggcactgcgcaggctgggta

SEQ ID NO: 843112 - DNA, 20 bp, mouse
gctccagtgctttgcggggt

SEQ ID NO: 843113 - DNA, 20 bp, mouse
gggactcgaagtgcaggaag

SEQ ID NO: 843114 - DNA, 20 bp, mouse
gtaagaaggactcgaagtgc

SEQ ID NO: 843115 - DNA, 20 bp, mouse
gagtgacgagtgggagggtg

SEQ ID NO: 843116 - DNA, 20 bp, mouse
ggtcccgcctccacgcagtg

SEQ ID NO: 843117 - DNA, 20 bp, mouse
gtgggtggtaaggcggggcg

SEQ ID NO: 843118 - DNA, 20 bp, mouse
gaggcggcggagctggcaat

SEQ ID NO: 843119 - DNA, 20 bp, mouse
gtcaagtcccgcccagtata

SEQ ID NO: 843120 - DNA, 20 bp, mouse
ggcggggcggggcttagttt

SEQ ID NO: 843121 - DNA, 20 bp, mouse
ggggcggggcttagtttggg

SEQ ID NO: 843122 - DNA, 20 bp, mouse
ggagctcaagacctcttagg

SEQ ID NO: 843123 - DNA, 20 bp, mouse
ggaaatgaaggacacctcgt

SEQ ID NO: 843124 - DNA, 20 bp, mouse
gatgaaggacacctcgtggg

SEQ ID NO: 843125 - DNA, 20 bp, mouse
gtgcgtggaggcgggacgat

SEQ ID NO: 843126 - DNA, 20 bp, mouse
ggacgcggcgccaggcaccg

SEQ ID NO: 843127 - DNA, 20 bp, mouse
ggctgcttaggaacgggcgg

SEQ ID NO: 843128 - DNA, 20 bp, mouse
gggagcgagttggcgagcag

SEQ ID NO: 843129 - DNA, 20 bp, mouse
ggcccgttcctaagcagccg

SEQ ID NO: 843130 - DNA, 20 bp, mouse
gccgctcggctcggcgcccg

SEQ ID NO: 843131 - DNA, 20 bp, mouse
ggaggaggccgcggctgctt

SEQ ID NO: 843132 - DNA, 20 bp, mouse
gtgcctggcgccgcgtcccg

SEQ ID NO: 843133 - DNA, 20 bp, mouse
gtaggaacgggcggcgggct

SEQ ID NO: 843134 - DNA, 20 bp, mouse
gctaagggatagggtctgac

SEQ ID NO: 843135 - DNA, 20 bp, mouse
ggtcgcacagggccggtagt

SEQ ID NO: 843136 - DNA, 20 bp, mouse
gactgcggacacgatcacat

SEQ ID NO: 843137 - DNA, 20 bp, mouse
gaaacctgcctggcaatcct

SEQ ID NO: 843138 - DNA, 20 bp, mouse
gctcccgccccctacgtagg

SEQ ID NO: 843139 - DNA, 20 bp, mouse
ggggccccacagggtgacga

SEQ ID NO: 843140 - DNA, 20 bp, mouse
gtgggtgtagagttgtgtcg

SEQ ID NO: 843141 - DNA, 20 bp, mouse
gtcacccagcccgctgccgg

SEQ ID NO: 843142 - DNA, 20 bp, mouse
gcactgcttctggtcttgaa

SEQ ID NO: 843143 - DNA, 20 bp, mouse
ggggcagcgccggggccctg

SEQ ID NO: 843144 - DNA, 20 bp, mouse
gtagagaccacctacgtagg

SEQ ID NO: 843145 - DNA, 20 bp, mouse
gtccccgccggcagcgggct

SEQ ID NO: 843146 - DNA, 20 bp, mouse
gggaaagagaccggaatcgt

SEQ ID NO: 843147 - DNA, 20 bp, mouse
gcgcccatccagcgacacta

SEQ ID NO: 843148 - DNA, 20 bp, mouse
gaatcagcgccctgcatcgc

SEQ ID NO: 843149 - DNA, 20 bp, mouse
gaggcatcggcgcgcagatg

SEQ ID NO: 843150 - DNA, 20 bp, mouse
gacaacctgcgagacgcggg

SEQ ID NO: 843151 - DNA, 20 bp, mouse
gaccggaagtggccggagat

SEQ ID NO: 843152 - DNA, 20 bp, mouse
gggaatcgtgggcagttctc

SEQ ID NO: 843153 - DNA, 20 bp, mouse
gtgagcgcttccggcgctgt

SEQ ID NO: 843154 - DNA, 20 bp, mouse
gagcgagatcatgttcgaag

SEQ ID NO: 843155 - DNA, 20 bp, mouse
gctgcctggttgagcgcttc

SEQ ID NO: 843156 - DNA, 20 bp, mouse
ggaagcagagaataatctga

SEQ ID NO: 843157 - DNA, 20 bp, mouse
gcccacagaaacaatctcag

SEQ ID NO: 843158 - DNA, 20 bp, mouse
gattttgtgtctaactccca

SEQ ID NO: 843159 - DNA, 20 bp, mouse
gcagactcatggcttggaaa

SEQ ID NO: 843160 - DNA, 20 bp, mouse
gaccttgtatttccaggcac

SEQ ID NO: 843161 - DNA, 20 bp, mouse
ggagggagagggccagccaa

SEQ ID NO: 843162 - DNA, 20 bp, mouse
gctagtgaggaggacttatc

SEQ ID NO: 843163 - DNA, 20 bp, mouse
gtcctgtctggaatctagtg

SEQ ID NO: 843164 - DNA, 20 bp, mouse
gcagactgtgttaggataaa

SEQ ID NO: 843165 - DNA, 20 bp, mouse
gggtgaattctatgccaaaa

SEQ ID NO: 843166 - DNA, 20 bp, mouse
gacacagccatgccggtcgg

SEQ ID NO: 843167 - DNA, 20 bp, mouse
ggggacacagccatgccggt

SEQ ID NO: 843168 - DNA, 20 bp, mouse
gtgagcagatgggatctttg

SEQ ID NO: 843169 - DNA, 20 bp, mouse
gcccagggacacagccatgc

SEQ ID NO: 843170 - DNA, 20 bp, mouse
ggatgtggagagtcagatct

SEQ ID NO: 843171 - DNA, 20 bp, mouse
gcacagggagcagtccctta

SEQ ID NO: 843172 - DNA, 20 bp, mouse
gctagtggcagtgacttcag

SEQ ID NO: 843173 - DNA, 20 bp, mouse
gtgacatgcaggcgccccca

SEQ ID NO: 843174 - DNA, 20 bp, mouse
gtgcacggagctgacgaact

SEQ ID NO: 843175 - DNA, 20 bp, mouse
gccagctggcaggagaagac

SEQ ID NO: 843176 - DNA, 20 bp, mouse
gttcccccggagggatctgt

SEQ ID NO: 843177 - DNA, 20 bp, mouse
ggatccctccgggggaaatc

SEQ ID NO: 843178 - DNA, 20 bp, mouse
gaagcctgatttcccccgga

SEQ ID NO: 843179 - DNA, 20 bp, mouse
gaagcctacagatccctccg

SEQ ID NO: 843180 - DNA, 20 bp, mouse
gccggaaaggggggcggaag

SEQ ID NO: 843181 - DNA, 20 bp, mouse
gccgcggcccgggccggaaa

SEQ ID NO: 843182 - DNA, 20 bp, mouse
gcaggtcaccgtgcactcag

SEQ ID NO: 843183 - DNA, 20 bp, mouse
gcggcccgggccggaaaggg

SEQ ID NO: 843184 - DNA, 20 bp, mouse
ggacttctgggtgacgtcac

SEQ ID NO: 843185 - DNA, 20 bp, mouse
gtaactggaaggggaatgtt

SEQ ID NO: 843186 - DNA, 20 bp, mouse
gcgcctggcgtctccagcgg

SEQ ID NO: 843187 - DNA, 20 bp, mouse
gcaccgcctggcgtctccag

SEQ ID NO: 843188 - DNA, 20 bp, mouse
gtgggctgaagtcaggacaa

SEQ ID NO: 843189 - DNA, 20 bp, mouse
gccgccttggtcacgcccac

SEQ ID NO: 843190 - DNA, 20 bp, mouse
gtggtcacgcccacgggagg

SEQ ID NO: 843191 - DNA, 20 bp, mouse
gaagtcaggacaaaggtatc

SEQ ID NO: 843192 - DNA, 20 bp, mouse
ggcacctggggcccggccgg

SEQ ID NO: 843193 - DNA, 20 bp, mouse
ggggcgtgaccaaggcggga

SEQ ID NO: 843194 - DNA, 20 bp, mouse
gagcgggggagccagaatcc

SEQ ID NO: 843195 - DNA, 20 bp, mouse
ggagctgtgtggtagtgcta

SEQ ID NO: 843196 - DNA, 20 bp, mouse
gagcccgggcctcgcccccc

SEQ ID NO: 843197 - DNA, 20 bp, mouse
gccgcctcctggaaggtgcg

SEQ ID NO: 843198 - DNA, 20 bp, mouse
gcggggcctgagctcctggg

SEQ ID NO: 843199 - DNA, 20 bp, mouse
ggggcgaggcccgggctcct

SEQ ID NO: 843200 - DNA, 20 bp, mouse
gaggcccgggctcctggggg

SEQ ID NO: 843201 - DNA, 20 bp, mouse
gctcctggggggcgaggccc

SEQ ID NO: 843202 - DNA, 20 bp, mouse
ggcgccgtaactatggagag

SEQ ID NO: 843203 - DNA, 20 bp, mouse
gggaggagccgcctcctgga

SEQ ID NO: 843204 - DNA, 20 bp, mouse
gctcaggggcgccgtaacta

SEQ ID NO: 843205 - DNA, 20 bp, mouse
gcccccgctctccatagtta

SEQ ID NO: 843206 - DNA, 20 bp, mouse
gcatccccccaaatcatata

SEQ ID NO: 843207 - DNA, 20 bp, mouse
gtcagcgtggactcggctgt

SEQ ID NO: 843208 - DNA, 20 bp, mouse
gcaaagttcccaaacaggta

SEQ ID NO: 843209 - DNA, 20 bp, mouse
gcgagcggctcctccctacg

SEQ ID NO: 843210 - DNA, 20 bp, mouse
ggggtgaaataataagaggc

SEQ ID NO: 843211 - DNA, 20 bp, mouse
gtgagcaaagttctgaatgc

SEQ ID NO: 843212 - DNA, 20 bp, mouse
gcctggggtgaaataataag

SEQ ID NO: 843213 - DNA, 20 bp, mouse
gcagcagtaggctggaccag

SEQ ID NO: 843214 - DNA, 20 bp, mouse
gggggggatgggcacgtcct

SEQ ID NO: 843215 - DNA, 20 bp, mouse
gtgggcatgagaggcatcct

SEQ ID NO: 843216 - DNA, 20 bp, mouse
ggaaacgtggagacctaggt

SEQ ID NO: 843217 - DNA, 20 bp, mouse
gcggacagaaatactcatcg

SEQ ID NO: 843218 - DNA, 20 bp, mouse
ggccgggcagacgccttaaa

SEQ ID NO: 843219 - DNA, 20 bp, mouse
gcgctctgacgctgcggcgt

SEQ ID NO: 843220 - DNA, 20 bp, mouse
ggagccggagacgcgtgacg

SEQ ID NO: 843221 - DNA, 20 bp, mouse
gttaaagggctcgtaaactg

SEQ ID NO: 843222 - DNA, 20 bp, mouse
gccgccccgtcacgcgtctc

SEQ ID NO: 843223 - DNA, 20 bp, mouse
gacgtggagacctaggtagg

SEQ ID NO: 843224 - DNA, 20 bp, mouse
gcgtaaactgcggggagtcc

SEQ ID NO: 843225 - DNA, 20 bp, mouse
gcttcctgcggcactgaaga

SEQ ID NO: 843226 - DNA, 20 bp, mouse
gcgggagcacgtagacttcg

SEQ ID NO: 843227 - DNA, 20 bp, mouse
ggggcggaaccaatccccaa

SEQ ID NO: 843228 - DNA, 20 bp, mouse
gaggcgtagcccttggggat

SEQ ID NO: 843229 - DNA, 20 bp, mouse
ggcagctccgcccactgaaa

SEQ ID NO: 843230 - DNA, 20 bp, mouse
gagtctacgtgctcccgggg

SEQ ID NO: 843231 - DNA, 20 bp, mouse
gcccagccggagtgagggga

SEQ ID NO: 843232 - DNA, 20 bp, mouse
gagactgggcgcgagcggat

SEQ ID NO: 843233 - DNA, 20 bp, mouse
ggggatcccagccggagtga

SEQ ID NO: 843234 - DNA, 20 bp, mouse
gccgggaggcgtagcccttg

SEQ ID NO: 843235 - DNA, 20 bp, mouse
gagggcttcaaagcaaggat

SEQ ID NO: 843236 - DNA, 20 bp, mouse
gcgctcctgtggaaggtcaa

SEQ ID NO: 843237 - DNA, 20 bp, mouse
gtgcgcaaaagtgcctaaaa

SEQ ID NO: 843238 - DNA, 20 bp, mouse
gaaagtggatggcgctcctg

SEQ ID NO: 843239 - DNA, 20 bp, mouse
ggtggaaggtcaagggtctg

SEQ ID NO: 843240 - DNA, 20 bp, mouse
ggtgccatcaatcaccagaa

SEQ ID NO: 843241 - DNA, 20 bp, mouse
gtggatggcgctcctgtgga

SEQ ID NO: 843242 - DNA, 20 bp, mouse
gcttgggaaatgtaagaaat

SEQ ID NO: 843243 - DNA, 20 bp, mouse
gtgccccttctggtgattga

SEQ ID NO: 843244 - DNA, 20 bp, mouse
ggagaactgcattccctttt

SEQ ID NO: 843245 - DNA, 20 bp, mouse
ggatacatcatgaagttaca

SEQ ID NO: 843246 - DNA, 20 bp, mouse
gaagccgcagggtgatgcaa

SEQ ID NO: 843247 - DNA, 20 bp, mouse
gcccacccaccgtcccacgg

SEQ ID NO: 843248 - DNA, 20 bp, mouse
gtggctgaggaagatctggc

SEQ ID NO: 843249 - DNA, 20 bp, mouse
gggcggggatgaaggctgaa

SEQ ID NO: 843250 - DNA, 20 bp, mouse
gactctccccagagcctccg

SEQ ID NO: 843251 - DNA, 20 bp, mouse
gcccgggctacactctgctg

SEQ ID NO: 843252 - DNA, 20 bp, mouse
gagagcctccgtgggacggt

SEQ ID NO: 843253 - DNA, 20 bp, mouse
gaacaccacaggtctccggt

SEQ ID NO: 843254 - DNA, 20 bp, mouse
gcttggagaaggccccacca

SEQ ID NO: 843255 - DNA, 20 bp, mouse
gctgcggccgggtggaaaca

SEQ ID NO: 843256 - DNA, 20 bp, mouse
ggccctctacaggttccagt

SEQ ID NO: 843257 - DNA, 20 bp, mouse
ggcgaggccaagaagtggtt

SEQ ID NO: 843258 - DNA, 20 bp, mouse
ggcgcctagtctgttcccac

SEQ ID NO: 843259 - DNA, 20 bp, mouse
gtcccactggaacctgtaga

SEQ ID NO: 843260 - DNA, 20 bp, mouse
gggaagaggctctaaaggaa

SEQ ID NO: 843261 - DNA, 20 bp, mouse
gggaacctgtagagggcgcg

SEQ ID NO: 843262 - DNA, 20 bp, mouse
gtgtagagggcgcgcggaag

SEQ ID NO: 843263 - DNA, 20 bp, mouse
gggctctaaaggaaaggcgg

SEQ ID NO: 843264 - DNA, 20 bp, mouse
gcgcgcggaagaggctctaa

SEQ ID NO: 843265 - DNA, 20 bp, mouse
gagtggttgggtctgtgcaa

SEQ ID NO: 843266 - DNA, 20 bp, mouse
gcccctgagcgaggtgttcg

SEQ ID NO: 843267 - DNA, 20 bp, mouse
ggccctcgaacacctcgctc

SEQ ID NO: 843268 - DNA, 20 bp, mouse
gcgagtcacccccttcacgt

SEQ ID NO: 843269 - DNA, 20 bp, mouse
gcatccatgcccacgtgaag

SEQ ID NO: 843270 - DNA, 20 bp, mouse
gtggggtgataaagtctgca

SEQ ID NO: 843271 - DNA, 20 bp, mouse
gggaagctgtcattgataca

SEQ ID NO: 843272 - DNA, 20 bp, mouse
gcagcagatcaagctgtctg

SEQ ID NO: 843273 - DNA, 20 bp, mouse
ggataaagtctgcagggtgg

SEQ ID NO: 843274 - DNA, 20 bp, mouse
gcctcgctcaggggcagtcc

SEQ ID NO: 843275 - DNA, 20 bp, mouse
gtggatgtccagtccaggca

SEQ ID NO: 843276 - DNA, 20 bp, mouse
gcaccccgcacggcccggaa

SEQ ID NO: 843277 - DNA, 20 bp, mouse
gggccgtgcggggtgaccga

SEQ ID NO: 843278 - DNA, 20 bp, mouse
gcgaggggaggtcacgtcga

SEQ ID NO: 843279 - DNA, 20 bp, mouse
ggcccaggacgaggcctcga

SEQ ID NO: 843280 - DNA, 20 bp, mouse
gcactggcaagctaccggcg

SEQ ID NO: 843281 - DNA, 20 bp, mouse
gggccctcggtcaccccgca

SEQ ID NO: 843282 - DNA, 20 bp, mouse
gcgggcgtgaaggaggatct

SEQ ID NO: 843283 - DNA, 20 bp, mouse
ggcaagctaccggcgagggt

SEQ ID NO: 843284 - DNA, 20 bp, mouse
gcaagtgcgggctacgtagc

SEQ ID NO: 843285 - DNA, 20 bp, mouse
gccgtgatccagtgtggtga

SEQ ID NO: 843286 - DNA, 20 bp, mouse
ggcagcccggggcccctccc

SEQ ID NO: 843287 - DNA, 20 bp, mouse
gtgtccctggagactgagag

SEQ ID NO: 843288 - DNA, 20 bp, mouse
gcgaagggatccccggtgca

SEQ ID NO: 843289 - DNA, 20 bp, mouse
gcgggccaccccctgcaccg

SEQ ID NO: 843290 - DNA, 20 bp, mouse
gagcctcaggcgttgcccga

SEQ ID NO: 843291 - DNA, 20 bp, mouse
gggcgccgcaaaatccggac

SEQ ID NO: 843292 - DNA, 20 bp, mouse
gaggactctggatcccggag

SEQ ID NO: 843293 - DNA, 20 bp, mouse
gtcccttcgggcaacgcctg

SEQ ID NO: 843294 - DNA, 20 bp, mouse
ggtggtaggcagctggcggg

SEQ ID NO: 843295 - DNA, 20 bp, mouse
gggaggcaggggtgcaagca

SEQ ID NO: 843296 - DNA, 20 bp, mouse
ggagccacggggcccagcga

SEQ ID NO: 843297 - DNA, 20 bp, mouse
gccacggggcccagcgaggg

SEQ ID NO: 843298 - DNA, 20 bp, mouse
gccccggcccgctgactcta

SEQ ID NO: 843299 - DNA, 20 bp, mouse
ggggtaccctaccgctgtgt

SEQ ID NO: 843300 - DNA, 20 bp, mouse
gaaaaccggtccgctgaaag

SEQ ID NO: 843301 - DNA, 20 bp, mouse
gtgtaggcgcggccgagttg

SEQ ID NO: 843302 - DNA, 20 bp, mouse
gctcggccgcgcctacacag

SEQ ID NO: 843303 - DNA, 20 bp, mouse
ggtagggtaccccccctcgc

SEQ ID NO: 843304 - DNA, 20 bp, mouse
gccgcgaagtctgtccgagt

SEQ ID NO: 843305 - DNA, 20 bp, mouse
gcctcacgcgatagaaggcg

SEQ ID NO: 843306 - DNA, 20 bp, mouse
gagcagccgggagacgtcag

SEQ ID NO: 843307 - DNA, 20 bp, mouse
ggggaggtggcaagagcggg

SEQ ID NO: 843308 - DNA, 20 bp, mouse
gggagctgcgggagctgtgg

SEQ ID NO: 843309 - DNA, 20 bp, mouse
gcctagccactgacgtctcc

SEQ ID NO: 843310 - DNA, 20 bp, mouse
gcccccactcgggaagtgct

SEQ ID NO: 843311 - DNA, 20 bp, mouse
gctcccagcacttcccgagt

SEQ ID NO: 843312 - DNA, 20 bp, mouse
gagtgctgggaggtgtagcg

SEQ ID NO: 843313 - DNA, 20 bp, mouse
gggcagcccgggagtctctc

SEQ ID NO: 843314 - DNA, 20 bp, mouse
gccgagcgggcgctgctctc

SEQ ID NO: 843315 - DNA, 20 bp, mouse
gtccaagggcaggggccaaa

SEQ ID NO: 843316 - DNA, 20 bp, mouse
gagagggcactgtgacaaga

SEQ ID NO: 843317 - DNA, 20 bp, mouse
ggcagtatggcggaagacta

SEQ ID NO: 843318 - DNA, 20 bp, mouse
gcccgagcttcacctggaat

SEQ ID NO: 843319 - DNA, 20 bp, mouse
gtcggggcttacagtcacgc

SEQ ID NO: 843320 - DNA, 20 bp, mouse
gcccaagtgtacttgtctac

SEQ ID NO: 843321 - DNA, 20 bp, mouse
gcctacaaaaggcagtatgg

SEQ ID NO: 843322 - DNA, 20 bp, mouse
gacagccgctcataagcaga

SEQ ID NO: 843323 - DNA, 20 bp, mouse
gactgtaagccccgactctg

SEQ ID NO: 843324 - DNA, 20 bp, mouse
gggcttacagtcacgctgga

SEQ ID NO: 843325 - DNA, 20 bp, mouse
ggtagagtgtctttgtctat

SEQ ID NO: 843326 - DNA, 20 bp, mouse
ggccagctgcagccacttgc

SEQ ID NO: 843327 - DNA, 20 bp, mouse
gagggagagagtgacttcga

SEQ ID NO: 843328 - DNA, 20 bp, mouse
ggggccagacagcccgcaag

SEQ ID NO: 843329 - DNA, 20 bp, mouse
gaacgcaggtgtagagactg

SEQ ID NO: 843330 - DNA, 20 bp, mouse
gctgctccccactggtgcca

SEQ ID NO: 843331 - DNA, 20 bp, mouse
ggtggcagagatctacacat

SEQ ID NO: 843332 - DNA, 20 bp, mouse
gcatctaaggggtctctatg

SEQ ID NO: 843333 - DNA, 20 bp, mouse
gaccagtggggagcagaaca

SEQ ID NO: 843334 - DNA, 20 bp, mouse
gggcgcagggagtgttgttc

SEQ ID NO: 843335 - DNA, 20 bp, mouse
gcaggtgtagagactgcgga

SEQ ID NO: 843336 - DNA, 20 bp, mouse
ggcggtgcccgcacgtgcgg

SEQ ID NO: 843337 - DNA, 20 bp, mouse
gccgccccggcgtgactcat

SEQ ID NO: 843338 - DNA, 20 bp, mouse
gagcgcccagcggcagaatg

SEQ ID NO: 843339 - DNA, 20 bp, mouse
gcccgcacgtgcggcggctg

SEQ ID NO: 843340 - DNA, 20 bp, mouse
gtggccgccgctcggagggg

SEQ ID NO: 843341 - DNA, 20 bp, mouse
gtctgctccacccctccgag

SEQ ID NO: 843342 - DNA, 20 bp, mouse
ggaggcggtgcccgcacgtg

SEQ ID NO: 843343 - DNA, 20 bp, mouse
gctgcaatcccgcacgcgcg

SEQ ID NO: 843344 - DNA, 20 bp, mouse
ggctccacccctccgagcgg

SEQ ID NO: 843345 - DNA, 20 bp, mouse
gcagaggcccccgcgcgtgc

SEQ ID NO: 843346 - DNA, 20 bp, mouse
gttagcggcacaatctccag

SEQ ID NO: 843347 - DNA, 20 bp, mouse
gacactgttgagaaactcac

SEQ ID NO: 843348 - DNA, 20 bp, mouse
gaatgcacgtagcagttagt

SEQ ID NO: 843349 - DNA, 20 bp, mouse
gagaaaggggagcaaacacg

SEQ ID NO: 843350 - DNA, 20 bp, mouse
ggatgagcgtattttgttag

SEQ ID NO: 843351 - DNA, 20 bp, mouse
ggagattaatgggatcaatg

SEQ ID NO: 843352 - DNA, 20 bp, mouse
ggaagtaagcagtcagccac

SEQ ID NO: 843353 - DNA, 20 bp, mouse
ggggggtcatctgaacagcg

SEQ ID NO: 843354 - DNA, 20 bp, mouse
gaaagtgctttgagattaat

SEQ ID NO: 843355 - DNA, 20 bp, mouse
ggggatgtcacaatttcact

SEQ ID NO: 843356 - DNA, 20 bp, mouse
gagaaccctgggtgccgaag

SEQ ID NO: 843357 - DNA, 20 bp, mouse
gtcgggtttagcaagaaggc

SEQ ID NO: 843358 - DNA, 20 bp, mouse
gcagccgcggagcagagccg

SEQ ID NO: 843359 - DNA, 20 bp, mouse
gggtgccgaagaggccgcgt

SEQ ID NO: 843360 - DNA, 20 bp, mouse
gtgctggggtgcactccgag

SEQ ID NO: 843361 - DNA, 20 bp, mouse
ggtcccccacgcggcctctt

SEQ ID NO: 843362 - DNA, 20 bp, mouse
gcaaagctcctcctccccag

SEQ ID NO: 843363 - DNA, 20 bp, mouse
ggaggagcaagcagaaccct

SEQ ID NO: 843364 - DNA, 20 bp, mouse
gggaggctggcttggcaagt

SEQ ID NO: 843365 - DNA, 20 bp, mouse
ggaaggactgtcgacctctg

SEQ ID NO: 843366 - DNA, 20 bp, mouse
gtcattggctgaattcttcg

SEQ ID NO: 843367 - DNA, 20 bp, mouse
gttggctgaattcttcgtgg

SEQ ID NO: 843368 - DNA, 20 bp, mouse
gtttggagtgagggctttgt

SEQ ID NO: 843369 - DNA, 20 bp, mouse
gactgcaggggctgtgggag

SEQ ID NO: 843370 - DNA, 20 bp, mouse
gaatgggagctttggagtga

SEQ ID NO: 843371 - DNA, 20 bp, mouse
gcggcccacccagcagaaaa

SEQ ID NO: 843372 - DNA, 20 bp, mouse
gccaaagctcccattctcct

SEQ ID NO: 843373 - DNA, 20 bp, mouse
gcccagcagaaaaaggaaaa

SEQ ID NO: 843374 - DNA, 20 bp, mouse
gaaaagggattccaagcccc

SEQ ID NO: 843375 - DNA, 20 bp, mouse
gaatgcctggtgtaccaatt

SEQ ID NO: 843376 - DNA, 20 bp, mouse
ggggtggggcctactagaca

SEQ ID NO: 843377 - DNA, 20 bp, mouse
gaggcggcccacactagacg

SEQ ID NO: 843378 - DNA, 20 bp, mouse
gcggcccacactagacgggg

SEQ ID NO: 843379 - DNA, 20 bp, mouse
ggccccaccccgtctagtgt

SEQ ID NO: 843380 - DNA, 20 bp, mouse
gacacaccatggacagtatt

SEQ ID NO: 843381 - DNA, 20 bp, mouse
gctcctcctaatactgtcca

SEQ ID NO: 843382 - DNA, 20 bp, mouse
gtggggcctactagacaggg

SEQ ID NO: 843383 - DNA, 20 bp, mouse
gaaagaccgccctgtctagt

SEQ ID NO: 843384 - DNA, 20 bp, mouse
gtgggcaccagcagctggtt

SEQ ID NO: 843385 - DNA, 20 bp, mouse
gtacaccgtacagccgggag

SEQ ID NO: 843386 - DNA, 20 bp, mouse
gtaatcggctctgacgtcag

SEQ ID NO: 843387 - DNA, 20 bp, mouse
gtgtcacaacaagacggggt

SEQ ID NO: 843388 - DNA, 20 bp, mouse
ggagctgtcacaacaagacg

SEQ ID NO: 843389 - DNA, 20 bp, mouse
gcacctccataaacagtatc

SEQ ID NO: 843390 - DNA, 20 bp, mouse
gcagaggcgtgctgggtgca

SEQ ID NO: 843391 - DNA, 20 bp, mouse
gagccgcggcccggggaatt

SEQ ID NO: 843392 - DNA, 20 bp, mouse
gctgacgtcagaggcgtgct

SEQ ID NO: 843393 - DNA, 20 bp, mouse
gctcctgatactgtttatgg

SEQ ID NO: 843394 - DNA, 20 bp, mouse
gtctaccagcggcctctccc

SEQ ID NO: 843395 - DNA, 20 bp, mouse
gggagtggggggctcgccgg

SEQ ID NO: 843396 - DNA, 20 bp, mouse
gcggccgcctcagagtcaat

SEQ ID NO: 843397 - DNA, 20 bp, mouse
gaggcccagcgcgcatgtgt

SEQ ID NO: 843398 - DNA, 20 bp, mouse
gggccgagctccgtccccat

SEQ ID NO: 843399 - DNA, 20 bp, mouse
gtggggaagtggaacatttc

SEQ ID NO: 843400 - DNA, 20 bp, mouse
gggtagatgtctcggcatgg

SEQ ID NO: 843401 - DNA, 20 bp, mouse
ggggcacgctgcacactgat

SEQ ID NO: 843402 - DNA, 20 bp, mouse
gtcccagtctggctgataaa

SEQ ID NO: 843403 - DNA, 20 bp, mouse
gagagctaggacaggtaggt

SEQ ID NO: 843404 - DNA, 20 bp, mouse
gtaccaatggggacggagct

SEQ ID NO: 843405 - DNA, 20 bp, mouse
gcctctaaggtgtcccagtc

SEQ ID NO: 843406 - DNA, 20 bp, mouse
gcgcaggcgctgtgggtctt

SEQ ID NO: 843407 - DNA, 20 bp, mouse
gggagagcaaggaaccagtt

SEQ ID NO: 843408 - DNA, 20 bp, mouse
ggaggcctgaaacaactcca

SEQ ID NO: 843409 - DNA, 20 bp, mouse
gaccgtccgcaaagatctct

SEQ ID NO: 843410 - DNA, 20 bp, mouse
gtgagcattgtcagtgtggt

SEQ ID NO: 843411 - DNA, 20 bp, mouse
ggcattgtcagtgtggtcgg

SEQ ID NO: 843412 - DNA, 20 bp, mouse
gcgttctcgtggcgcggcgc

SEQ ID NO: 843413 - DNA, 20 bp, mouse
ggacggtgtcccggatgctg

SEQ ID NO: 843414 - DNA, 20 bp, mouse
ggtgaactctacctttaaac

SEQ ID NO: 843415 - DNA, 20 bp, mouse
ggccaacggtaaaatttcac

SEQ ID NO: 843416 - DNA, 20 bp, mouse
ggcacagcgcgcgtgggcga

SEQ ID NO: 843417 - DNA, 20 bp, mouse
ggcccacgcgcgctgtgcgg

SEQ ID NO: 843418 - DNA, 20 bp, mouse
ggtgggcgaggggtcggtgg

SEQ ID NO: 843419 - DNA, 20 bp, mouse
gcaccacggcagcaagttac

SEQ ID NO: 843420 - DNA, 20 bp, mouse
gcacgcgcgctgtgcggcgg

SEQ ID NO: 843421 - DNA, 20 bp, mouse
gcaaggcgggacacgcccgt

SEQ ID NO: 843422 - DNA, 20 bp, mouse
gatggggactctacaccaac

SEQ ID NO: 843423 - DNA, 20 bp, mouse
gacccccgggcacgccacgc

SEQ ID NO: 843424 - DNA, 20 bp, mouse
gaggttctgccggcccacca

SEQ ID NO: 843425 - DNA, 20 bp, mouse
gtggccggcgtggcgtgccc

SEQ ID NO: 843426 - DNA, 20 bp, mouse
gtcgctgagtggtcagaacc

SEQ ID NO: 843427 - DNA, 20 bp, mouse
gggttattaacctattacat

SEQ ID NO: 843428 - DNA, 20 bp, mouse
gagtcgacaactgagcacaa

SEQ ID NO: 843429 - DNA, 20 bp, mouse
ggaccactcagcgaggcatt

SEQ ID NO: 843430 - DNA, 20 bp, mouse
gctatagtagcctatgtaat

SEQ ID NO: 843431 - DNA, 20 bp, mouse
gactgtccactatgcaatca

SEQ ID NO: 843432 - DNA, 20 bp, mouse
ggaagcaaccttcagaatag

SEQ ID NO: 843433 - DNA, 20 bp, mouse
gtactgccctgattgcatag

SEQ ID NO: 843434 - DNA, 20 bp, mouse
gcttctaaccactattctga

SEQ ID NO: 843435 - DNA, 20 bp, mouse
ggaaaaatctggagggaaag

SEQ ID NO: 843436 - DNA, 20 bp, mouse
ggacctgcactgatccaacc

SEQ ID NO: 843437 - DNA, 20 bp, mouse
ggaaggaggcgcctgtgtta

SEQ ID NO: 843438 - DNA, 20 bp, mouse
gtattggctgccctccatag

SEQ ID NO: 843439 - DNA, 20 bp, mouse
gccaatagaaaaggtctgcc

SEQ ID NO: 843440 - DNA, 20 bp, mouse
ggagagagcgccaatagaaa

SEQ ID NO: 843441 - DNA, 20 bp, mouse
gactacacggggctgctgat

SEQ ID NO: 843442 - DNA, 20 bp, mouse
ggtgttagggaaagcctcca

SEQ ID NO: 843443 - DNA, 20 bp, mouse
gctcctcacgcctctatgga

SEQ ID NO: 843444 - DNA, 20 bp, mouse
gtcagcccatcaaagatcta

SEQ ID NO: 843445 - DNA, 20 bp, mouse
gagcagccccgtgtagtagt

SEQ ID NO: 843446 - DNA, 20 bp, mouse
gcaggcgcgcgcgttcctcc

SEQ ID NO: 843447 - DNA, 20 bp, mouse
gggaaagtagccaaccgcac

SEQ ID NO: 843448 - DNA, 20 bp, mouse
gaaggcccgcctcttcgcgc

SEQ ID NO: 843449 - DNA, 20 bp, mouse
gagctcccagtgctccggtg

SEQ ID NO: 843450 - DNA, 20 bp, mouse
gcggagcactgggagctaag

SEQ ID NO: 843451 - DNA, 20 bp, mouse
gtgcgcctgcgcgaagaggc

SEQ ID NO: 843452 - DNA, 20 bp, mouse
gcaccgctaggcagcagttg

SEQ ID NO: 843453 - DNA, 20 bp, mouse
gcgagcccaggtcctttagg

SEQ ID NO: 843454 - DNA, 20 bp, mouse
gcgcacgcgcaccgcagcgg

SEQ ID NO: 843455 - DNA, 20 bp, mouse
gtcagggctggatgttcgtt

SEQ ID NO: 843456 - DNA, 20 bp, mouse
gcgcccgccactcaccaacg

SEQ ID NO: 843457 - DNA, 20 bp, mouse
gacggggcggaactctaagg

SEQ ID NO: 843458 - DNA, 20 bp, mouse
gtgaacacatagcgagggac

SEQ ID NO: 843459 - DNA, 20 bp, mouse
gcaacgcggccgggctgcta

SEQ ID NO: 843460 - DNA, 20 bp, mouse
gcgccactcaccaacgcggc

SEQ ID NO: 843461 - DNA, 20 bp, mouse
ggggattgaacacatagcga

SEQ ID NO: 843462 - DNA, 20 bp, mouse
gccaaatggaccttcgtctc

SEQ ID NO: 843463 - DNA, 20 bp, mouse
ggcccggccgcgttggtgag

SEQ ID NO: 843464 - DNA, 20 bp, mouse
gggcggagcgcagagggaaa

SEQ ID NO: 843465 - DNA, 20 bp, mouse
ggggccctcgtctgcgagag

SEQ ID NO: 843466 - DNA, 20 bp, mouse
gcagcagcgcacgggacgtc

SEQ ID NO: 843467 - DNA, 20 bp, mouse
gcggcgacggtgaaggagat

SEQ ID NO: 843468 - DNA, 20 bp, mouse
gcccgtgcgctgctgacctg

SEQ ID NO: 843469 - DNA, 20 bp, mouse
gcgtcctagaacggcggcga

SEQ ID NO: 843470 - DNA, 20 bp, mouse
gagcggacgtcctagaacgg

SEQ ID NO: 843471 - DNA, 20 bp, mouse
gaaaacgtgtaggagggagg

SEQ ID NO: 843472 - DNA, 20 bp, mouse
gagaacggcggcgacggtga

SEQ ID NO: 843473 - DNA, 20 bp, mouse
gctgacctgcggtggggact

SEQ ID NO: 843474 - DNA, 20 bp, mouse
ggcgctgctgacctgcggtg

SEQ ID NO: 843475 - DNA, 20 bp, mouse
gggctcccagtccccaccgc

SEQ ID NO: 843476 - DNA, 20 bp, mouse
gcaggcgggaagtaaaggtc

SEQ ID NO: 843477 - DNA, 20 bp, mouse
gagggaatctgggccgctag

SEQ ID NO: 843478 - DNA, 20 bp, mouse
gggcgggccccgagggaatc

SEQ ID NO: 843479 - DNA, 20 bp, mouse
gaggccctcggtttcactcg

SEQ ID NO: 843480 - DNA, 20 bp, mouse
gctaggggattgggcagcat

SEQ ID NO: 843481 - DNA, 20 bp, mouse
gttcggcaggcgggaagtaa

SEQ ID NO: 843482 - DNA, 20 bp, mouse
ggggagcccaatggaacgca

SEQ ID NO: 843483 - DNA, 20 bp, mouse
gcagagccctgcgttccatt

SEQ ID NO: 843484 - DNA, 20 bp, mouse
ggcagcatggggacttcggc

SEQ ID NO: 843485 - DNA, 20 bp, mouse
ggtctctcccggagagtcgt

SEQ ID NO: 843486 - DNA, 20 bp, mouse
ggcagccatgccagaggggt

SEQ ID NO: 843487 - DNA, 20 bp, mouse
gaaagcctaccgtgcaccta

SEQ ID NO: 843488 - DNA, 20 bp, mouse
gcccagaggctctaattccc

SEQ ID NO: 843489 - DNA, 20 bp, mouse
gtccacgcggccgtcccggg

SEQ ID NO: 843490 - DNA, 20 bp, mouse
gcagcagaggataatggggt

SEQ ID NO: 843491 - DNA, 20 bp, mouse
gccacacagcagaggataat

SEQ ID NO: 843492 - DNA, 20 bp, mouse
gatccatgacagatcctcgt

SEQ ID NO: 843493 - DNA, 20 bp, mouse
gaggggtttgggcatatata

SEQ ID NO: 843494 - DNA, 20 bp, mouse
gttcccacgaggatctgtca

SEQ ID NO: 843495 - DNA, 20 bp, mouse
gctaatgtgggattcccacg

SEQ ID NO: 843496 - DNA, 20 bp, mouse
gaccctgcgcaagtagagga

SEQ ID NO: 843497 - DNA, 20 bp, mouse
ggggaggaggcatctcacat

SEQ ID NO: 843498 - DNA, 20 bp, mouse
ggggaagggtggtctgtgag

SEQ ID NO: 843499 - DNA, 20 bp, mouse
gagcgtcagaggatacagtg

SEQ ID NO: 843500 - DNA, 20 bp, mouse
ggacgctccggtccggggaa

SEQ ID NO: 843501 - DNA, 20 bp, mouse
gccccggaccggagcgtcag

SEQ ID NO: 843502 - DNA, 20 bp, mouse
gacccctcgaatatagcctg

SEQ ID NO: 843503 - DNA, 20 bp, mouse
ggtggtctgtgagtgggagg

SEQ ID NO: 843504 - DNA, 20 bp, mouse
gctccctcctctacttgcgc

SEQ ID NO: 843505 - DNA, 20 bp, mouse
gcaccacaggctatattcga

SEQ ID NO: 843506 - DNA, 20 bp, mouse
gtggccctcgggcctaaagg

SEQ ID NO: 843507 - DNA, 20 bp, mouse
gggcctaaagggggatgctc

SEQ ID NO: 843508 - DNA, 20 bp, mouse
gggccccagacaggtttttc

SEQ ID NO: 843509 - DNA, 20 bp, mouse
gcatccccctttaggcccga

SEQ ID NO: 843510 - DNA, 20 bp, mouse
gggcactgtagcctcaggga

SEQ ID NO: 843511 - DNA, 20 bp, mouse
gctgaggctacagtgcccaa

SEQ ID NO: 843512 - DNA, 20 bp, mouse
gagcctgaaaaacctgtctg

SEQ ID NO: 843513 - DNA, 20 bp, mouse
ggaactctgtccttcagtcg

SEQ ID NO: 843514 - DNA, 20 bp, mouse
gagctggccctcgggcctaa

SEQ ID NO: 843515 - DNA, 20 bp, mouse
gcagtgcccaaggggcaagt

SEQ ID NO: 843516 - DNA, 20 bp, mouse
gtcaaggggaggcttcggat

SEQ ID NO: 843517 - DNA, 20 bp, mouse
ggtgtgcagaaactaagctg

SEQ ID NO: 843518 - DNA, 20 bp, mouse
ggtcttctgcaaagctccta

SEQ ID NO: 843519 - DNA, 20 bp, mouse
gggcccaaggaggtaaggaa

SEQ ID NO: 843520 - DNA, 20 bp, mouse
gaggtcccaaagatgcttat

SEQ ID NO: 843521 - DNA, 20 bp, mouse
gctctgggcgggaggagccc

SEQ ID NO: 843522 - DNA, 20 bp, mouse
gagctttagttgctctgggc

SEQ ID NO: 843523 - DNA, 20 bp, mouse
gttgcatacagtccggtcct

SEQ ID NO: 843524 - DNA, 20 bp, mouse
gatcagagctttagttgctc

SEQ ID NO: 843525 - DNA, 20 bp, mouse
gagtatctggcacatagtat

SEQ ID NO: 843526 - DNA, 20 bp, mouse
gggccccactccagaactaa

SEQ ID NO: 843527 - DNA, 20 bp, mouse
gccagggccagggagtaagg

SEQ ID NO: 843528 - DNA, 20 bp, mouse
ggagaggagccatttagggt

SEQ ID NO: 843529 - DNA, 20 bp, mouse
gagactcccctcctctatct

SEQ ID NO: 843530 - DNA, 20 bp, mouse
ggtggtaccaccttactccc

SEQ ID NO: 843531 - DNA, 20 bp, mouse
gggctcctctcccttagttc

SEQ ID NO: 843532 - DNA, 20 bp, mouse
gaggatggatggccagaggg

SEQ ID NO: 843533 - DNA, 20 bp, mouse
gttgggatggaggtgactgg

SEQ ID NO: 843534 - DNA, 20 bp, mouse
gtatccaggaagtgaggaga

SEQ ID NO: 843535 - DNA, 20 bp, mouse
ggaggggagtctccctccca

SEQ ID NO: 843536 - DNA, 20 bp, mouse
gcccgactccacaagagcct

SEQ ID NO: 843537 - DNA, 20 bp, mouse
gaggctgaggctataggctc

SEQ ID NO: 843538 - DNA, 20 bp, mouse
ggaggggccaggtatgaagc

SEQ ID NO: 843539 - DNA, 20 bp, mouse
gggactgtgaggtgctctag

SEQ ID NO: 843540 - DNA, 20 bp, mouse
gactcagcatcactagggat

SEQ ID NO: 843541 - DNA, 20 bp, mouse
ggggatgggtccaaaaagaa

SEQ ID NO: 843542 - DNA, 20 bp, mouse
ggggggactcagcatcacta

SEQ ID NO: 843543 - DNA, 20 bp, mouse
gaaaaagaacggacagatgg

SEQ ID NO: 843544 - DNA, 20 bp, mouse
gtgcctgaggctgctcccgg

SEQ ID NO: 843545 - DNA, 20 bp, mouse
gactggttggacaggttcag

SEQ ID NO: 843546 - DNA, 20 bp, mouse
ggctagagaaggtgtggtcg

SEQ ID NO: 843547 - DNA, 20 bp, mouse
ggcgggagacagatcagggg

SEQ ID NO: 843548 - DNA, 20 bp, mouse
gtggctttggctccgctgga

SEQ ID NO: 843549 - DNA, 20 bp, mouse
gccgcccagaggtcaccgcc

SEQ ID NO: 843550 - DNA, 20 bp, mouse
ggatcaggaaggaccctgag

SEQ ID NO: 843551 - DNA, 20 bp, mouse
gtgttcgggcgagcaggtcc

SEQ ID NO: 843552 - DNA, 20 bp, mouse
ggtgtggtcggggcgtgttc

SEQ ID NO: 843553 - DNA, 20 bp, mouse
gaaagccaggcggtgacctc

SEQ ID NO: 843554 - DNA, 20 bp, mouse
gcgaacccggaaaagttgcc

SEQ ID NO: 843555 - DNA, 20 bp, mouse
gggaacagagatagcagctt

SEQ ID NO: 843556 - DNA, 20 bp, mouse
gggaccaaggtcacatgccc

SEQ ID NO: 843557 - DNA, 20 bp, mouse
ggtgaccttggtcccaacgt

SEQ ID NO: 843558 - DNA, 20 bp, mouse
gctgtcctacgttgggacca

SEQ ID NO: 843559 - DNA, 20 bp, mouse
gcaaaggagcctatcttctt

SEQ ID NO: 843560 - DNA, 20 bp, mouse
ggtcacacctgtcctacgtt

SEQ ID NO: 843561 - DNA, 20 bp, mouse
gtgtccagggcatgtgacct

SEQ ID NO: 843562 - DNA, 20 bp, mouse
ggctgggcacatttctgatg

SEQ ID NO: 843563 - DNA, 20 bp, mouse
gaatcattccccaagaagat

SEQ ID NO: 843564 - DNA, 20 bp, mouse
ggtagagtcaacctagtact

SEQ ID NO: 843565 - DNA, 20 bp, mouse
ggcaagtagtggagcaggct

SEQ ID NO: 843566 - DNA, 20 bp, mouse
gcgggtggattacacatgta

SEQ ID NO: 843567 - DNA, 20 bp, mouse
gaagtcctaggggttttctg

SEQ ID NO: 843568 - DNA, 20 bp, mouse
gtatcacagttgcttggcag

SEQ ID NO: 843569 - DNA, 20 bp, mouse
gccggcagtgcgtctggtgt

SEQ ID NO: 843570 - DNA, 20 bp, mouse
gcagcaaccagggatatctc

SEQ ID NO: 843571 - DNA, 20 bp, mouse
gtatgggcaaagcgtgcgaa

SEQ ID NO: 843572 - DNA, 20 bp, mouse
gaaaggaccgtagaggccta

SEQ ID NO: 843573 - DNA, 20 bp, mouse
gtagagccaagaaaagatac

SEQ ID NO: 843574 - DNA, 20 bp, mouse
gaaaccagcatgctgtagac

SEQ ID NO: 843575 - DNA, 20 bp, mouse
ggctaaaccagagatatccc

SEQ ID NO: 843576 - DNA, 20 bp, mouse
ggctgttaggggttaacgga

SEQ ID NO: 843577 - DNA, 20 bp, mouse
gcgcagcagcgacttaagac

SEQ ID NO: 843578 - DNA, 20 bp, mouse
gtcgctgctgcgcgtcacaa

SEQ ID NO: 843579 - DNA, 20 bp, mouse
gggttaacggaaggatgaga

SEQ ID NO: 843580 - DNA, 20 bp, mouse
gggcggagtcaggaaagaaa

SEQ ID NO: 843581 - DNA, 20 bp, mouse
gcagcgacttaagaccggcg

SEQ ID NO: 843582 - DNA, 20 bp, mouse
gcctgccgtggatctgaatg

SEQ ID NO: 843583 - DNA, 20 bp, mouse
ggggacagcggctgagtggg

SEQ ID NO: 843584 - DNA, 20 bp, mouse
gaggacgcgagactcctcgc

SEQ ID NO: 843585 - DNA, 20 bp, mouse
gaaaggtagtcaggctctgg

SEQ ID NO: 843586 - DNA, 20 bp, mouse
ggtactcgcccagctcccag

SEQ ID NO: 843587 - DNA, 20 bp, mouse
gcccaggggcaaagctaacg

SEQ ID NO: 843588 - DNA, 20 bp, mouse
gcaacggcccacacccctcc

SEQ ID NO: 843589 - DNA, 20 bp, mouse
gcaaaacagcagaggtctcg

SEQ ID NO: 843590 - DNA, 20 bp, mouse
ggctcagacctcgctctcaa

SEQ ID NO: 843591 - DNA, 20 bp, mouse
gctcttcagcttcttggttc

SEQ ID NO: 843592 - DNA, 20 bp, mouse
gtgtgtgtgtacacgacgga

SEQ ID NO: 843593 - DNA, 20 bp, mouse
gagtgcgcacgcgccctctg

SEQ ID NO: 843594 - DNA, 20 bp, mouse
gagcagcgccgctgcctgga

SEQ ID NO: 843595 - DNA, 20 bp, mouse
ggctaacgcggtgtaccctg

SEQ ID NO: 843596 - DNA, 20 bp, mouse
gcgaaggcgagacagcactg

SEQ ID NO: 843597 - DNA, 20 bp, mouse
gcaaacgcaggaaatggttg

SEQ ID NO: 843598 - DNA, 20 bp, mouse
ggggaagatgggtaagctaa

SEQ ID NO: 843599 - DNA, 20 bp, mouse
gtcaacgcgccctgctttat

SEQ ID NO: 843600 - DNA, 20 bp, mouse
gccttcctaaggtaccgaga

SEQ ID NO: 843601 - DNA, 20 bp, mouse
gcgcaacgcgaggactcaag

SEQ ID NO: 843602 - DNA, 20 bp, mouse
gccgagaaggcggaatacga

SEQ ID NO: 843603 - DNA, 20 bp, mouse
ggatgcagccacagaaactc

SEQ ID NO: 843604 - DNA, 20 bp, mouse
gagaaactgataatgtgcac

SEQ ID NO: 843605 - DNA, 20 bp, mouse
gaatagccaaacgcaggaaa

SEQ ID NO: 843606 - DNA, 20 bp, mouse
gcacactggaacaccgggga

SEQ ID NO: 843607 - DNA, 20 bp, mouse
gtgtaagcctggggtagaca

SEQ ID NO: 843608 - DNA, 20 bp, mouse
gcatgcacactggaacaccg

SEQ ID NO: 843609 - DNA, 20 bp, mouse
gcacagaaccaggacagaag

SEQ ID NO: 843610 - DNA, 20 bp, mouse
gtgtgcatggagctactgct

SEQ ID NO: 843611 - DNA, 20 bp, mouse
gcacggccagccctgaatat

SEQ ID NO: 843612 - DNA, 20 bp, mouse
ggcgccacccccggaaaagg

SEQ ID NO: 843613 - DNA, 20 bp, mouse
gacattgacatctacttccg

SEQ ID NO: 843614 - DNA, 20 bp, mouse
gtaccccaggcttacacttt

SEQ ID NO: 843615 - DNA, 20 bp, mouse
gtactgatccgcttctgtcc

SEQ ID NO: 843616 - DNA, 20 bp, mouse
gtgaatggactccacacatt

SEQ ID NO: 843617 - DNA, 20 bp, mouse
ggggaaagtactgcgaaatt

SEQ ID NO: 843618 - DNA, 20 bp, mouse
gaaaagatcagcctaatgtg

SEQ ID NO: 843619 - DNA, 20 bp, mouse
gacacgccgggctcctacgc

SEQ ID NO: 843620 - DNA, 20 bp, mouse
gcattcttcgcgacacaatg

SEQ ID NO: 843621 - DNA, 20 bp, mouse
ggtcctggatactttaggaa

SEQ ID NO: 843622 - DNA, 20 bp, mouse
gtgtggtagactcaatctat

SEQ ID NO: 843623 - DNA, 20 bp, mouse
gttactctttcctacctgaa

SEQ ID NO: 843624 - DNA, 20 bp, mouse
gggagcccggcgtgtcctct

SEQ ID NO: 843625 - DNA, 20 bp, mouse
gcaggcgtcctggatacttt

SEQ ID NO: 843626 - DNA, 20 bp, mouse
gtcagatgggaccagatgaa

SEQ ID NO: 843627 - DNA, 20 bp, mouse
ggggaggcggtatgcaactg

SEQ ID NO: 843628 - DNA, 20 bp, mouse
gctgaggcgcaagcgctgta

SEQ ID NO: 843629 - DNA, 20 bp, mouse
gaatgtcccgaagatcctag

SEQ ID NO: 843630 - DNA, 20 bp, mouse
gcgtgtgcctctaggatctt

SEQ ID NO: 843631 - DNA, 20 bp, mouse
ggtgctcagtcgccccctgt

SEQ ID NO: 843632 - DNA, 20 bp, mouse
gaacgtacttgctgcccaac

SEQ ID NO: 843633 - DNA, 20 bp, mouse
ggagggaggggcccttcatc

SEQ ID NO: 843634 - DNA, 20 bp, mouse
ggtacttgctgcccaacagg

SEQ ID NO: 843635 - DNA, 20 bp, mouse
gtgcctagccactgccctcc

SEQ ID NO: 843636 - DNA, 20 bp, mouse
gggagaggctagaggtctcc

SEQ ID NO: 843637 - DNA, 20 bp, mouse
gggcaggcccaagacggctg

SEQ ID NO: 843638 - DNA, 20 bp, mouse
gtggcgagggacgacctccg

SEQ ID NO: 843639 - DNA, 20 bp, mouse
gagacctctagcctctcccc

SEQ ID NO: 843640 - DNA, 20 bp, mouse
gaaaagctgcaatctagtcc

SEQ ID NO: 843641 - DNA, 20 bp, mouse
gctcacgggcaggcccaaga

SEQ ID NO: 843642 - DNA, 20 bp, mouse
gcggacttgcgaggactcac

SEQ ID NO: 843643 - DNA, 20 bp, mouse
gactacagtaaaagtggcga

SEQ ID NO: 843644 - DNA, 20 bp, mouse
ggggacgacctccgaggaac

SEQ ID NO: 843645 - DNA, 20 bp, mouse
ggggaagactacagtaaaag

SEQ ID NO: 843646 - DNA, 20 bp, mouse
ggggagggacgccgcgttgg

SEQ ID NO: 843647 - DNA, 20 bp, mouse
gcgggcgcaggttggggccc

SEQ ID NO: 843648 - DNA, 20 bp, mouse
gccccaggaaaaccgaagtc

SEQ ID NO: 843649 - DNA, 20 bp, mouse
gtggcttcgggcgcaggttg

SEQ ID NO: 843650 - DNA, 20 bp, mouse
gggcccgggcaggaaagggc

SEQ ID NO: 843651 - DNA, 20 bp, mouse
gagggcaaaaccttaaatcg

SEQ ID NO: 843652 - DNA, 20 bp, mouse
gcgaagccacgcccccaacg

SEQ ID NO: 843653 - DNA, 20 bp, mouse
ggttggggcccgggcaggaa

SEQ ID NO: 843654 - DNA, 20 bp, mouse
gccggaaagggcgtttcgca

SEQ ID NO: 843655 - DNA, 20 bp, mouse
gttcgcaaggttgagcgaat

SEQ ID NO: 843656 - DNA, 20 bp, mouse
gtgggcaagaagtgaccgaa

SEQ ID NO: 843657 - DNA, 20 bp, mouse
ggctagctacgagacgtagg

SEQ ID NO: 843658 - DNA, 20 bp, mouse
gcgcccgcacagctcgaaca

SEQ ID NO: 843659 - DNA, 20 bp, mouse
ggcccgcgggtgtcattctc

SEQ ID NO: 843660 - DNA, 20 bp, mouse
gctcgctagctacgagacgt

SEQ ID NO: 843661 - DNA, 20 bp, mouse
gagcccgagaatgacacccg

SEQ ID NO: 843662 - DNA, 20 bp, mouse
gaccatggaggccacgtccc

SEQ ID NO: 843663 - DNA, 20 bp, mouse
ggaccgctccataagggata

SEQ ID NO: 843664 - DNA, 20 bp, mouse
gacagctcgaacagggcggg

SEQ ID NO: 843665 - DNA, 20 bp, mouse
gttaaaagatcgtcaaacag

SEQ ID NO: 843666 - DNA, 20 bp, mouse
gagggctgggcggagcttag

SEQ ID NO: 843667 - DNA, 20 bp, mouse
gaagctccgcccagccctct

SEQ ID NO: 843668 - DNA, 20 bp, mouse
gttcgcccgtcacttccggg

SEQ ID NO: 843669 - DNA, 20 bp, mouse
gggtcaggccacgcccactc

SEQ ID NO: 843670 - DNA, 20 bp, mouse
gtagccaccctggggatctt

SEQ ID NO: 843671 - DNA, 20 bp, mouse
gggcctgaccttcgtgtagc

SEQ ID NO: 843672 - DNA, 20 bp, mouse
gagtagtgaacgcacgggag

SEQ ID NO: 843673 - DNA, 20 bp, mouse
gggcgcttctagcgacacgt

SEQ ID NO: 843674 - DNA, 20 bp, mouse
gccacctaagatccccaggg

SEQ ID NO: 843675 - DNA, 20 bp, mouse
ggggcgcggattagggtgat

SEQ ID NO: 843676 - DNA, 20 bp, mouse
gtccgcttaaggctatgatc

SEQ ID NO: 843677 - DNA, 20 bp, mouse
ggtaggggtaatatgtgtgc

SEQ ID NO: 843678 - DNA, 20 bp, mouse
gtggcggatagctcagtatt

SEQ ID NO: 843679 - DNA, 20 bp, mouse
ggggaggagcttatccagaa

SEQ ID NO: 843680 - DNA, 20 bp, mouse
gtatccgccacctccgctta

SEQ ID NO: 843681 - DNA, 20 bp, mouse
gtagccttaagcggaggtgg

SEQ ID NO: 843682 - DNA, 20 bp, mouse
ggtcctgcgatgagaaacac

SEQ ID NO: 843683 - DNA, 20 bp, mouse
gacatgctggccctgtgcaa

SEQ ID NO: 843684 - DNA, 20 bp, mouse
gtctcatcgcaggaccgttc

SEQ ID NO: 843685 - DNA, 20 bp, mouse
gagggtctcacgcatgctcg

SEQ ID NO: 843686 - DNA, 20 bp, mouse
gaggggaggggcagttctga

SEQ ID NO: 843687 - DNA, 20 bp, mouse
gtaaatggctgggtcaggga

SEQ ID NO: 843688 - DNA, 20 bp, mouse
gtggggaaggagggatactg

SEQ ID NO: 843689 - DNA, 20 bp, mouse
gctggtggaaagtgattaaa

SEQ ID NO: 843690 - DNA, 20 bp, mouse
ggagtggaagggcaagtctg

SEQ ID NO: 843691 - DNA, 20 bp, mouse
gaggttgggagcatgctgtg

SEQ ID NO: 843692 - DNA, 20 bp, mouse
gggaagggcaagtctgggga

SEQ ID NO: 843693 - DNA, 20 bp, mouse
gctgactagagagcttgttg

SEQ ID NO: 843694 - DNA, 20 bp, mouse
gtgattaaatggctgggtca

SEQ ID NO: 843695 - DNA, 20 bp, mouse
gcaggctgccagggctcatc

SEQ ID NO: 843696 - DNA, 20 bp, mouse
gggagaaggtagaacacctg

SEQ ID NO: 843697 - DNA, 20 bp, mouse
ggccttctggggcgtgtctc

SEQ ID NO: 843698 - DNA, 20 bp, mouse
gtgcttgggtggggcctgta

SEQ ID NO: 843699 - DNA, 20 bp, mouse
ggaaaggcggagcctatgag

SEQ ID NO: 843700 - DNA, 20 bp, mouse
ggggtgagaaagggcggaag

SEQ ID NO: 843701 - DNA, 20 bp, mouse
ggggaaatcccaggccctac

SEQ ID NO: 843702 - DNA, 20 bp, mouse
ggcgtgtctctgggtggtgt

SEQ ID NO: 843703 - DNA, 20 bp, mouse
gcacagccagagaacccttg

SEQ ID NO: 843704 - DNA, 20 bp, mouse
gagcaccggcggcaaggaag

SEQ ID NO: 843705 - DNA, 20 bp, mouse
gaaggtagaacacctggggg

SEQ ID NO: 843706 - DNA, 20 bp, mouse
gccggcgtgcccgctccgtc

SEQ ID NO: 843707 - DNA, 20 bp, mouse
gggcacgccgggctaggccg

SEQ ID NO: 843708 - DNA, 20 bp, mouse
ggcgagcgcgggaggacgta

SEQ ID NO: 843709 - DNA, 20 bp, mouse
gcgcactcactgaacatccc

SEQ ID NO: 843710 - DNA, 20 bp, mouse
gaccccgcacgtggcggccc

SEQ ID NO: 843711 - DNA, 20 bp, mouse
gctacggcgggcaaccgata

SEQ ID NO: 843712 - DNA, 20 bp, mouse
ggaagcagccggtgccgggg

SEQ ID NO: 843713 - DNA, 20 bp, mouse
ggcaccggctgcttccgtat

SEQ ID NO: 843714 - DNA, 20 bp, mouse
gcgctccgtcaggcggtcat

SEQ ID NO: 843715 - DNA, 20 bp, mouse
gctcccgcgctcgcggttct

SEQ ID NO: 843716 - DNA, 20 bp, mouse
gaagcagaggggtgtctccc

SEQ ID NO: 843717 - DNA, 20 bp, mouse
gtaccaggctctaggttaat

SEQ ID NO: 843718 - DNA, 20 bp, mouse
gcccgcgagtcgcccgccag

SEQ ID NO: 843719 - DNA, 20 bp, mouse
gcgggagaatttcatcccgt

SEQ ID NO: 843720 - DNA, 20 bp, mouse
gtgggctaatacaaacctac

SEQ ID NO: 843721 - DNA, 20 bp, mouse
gggggcggagtcatgcgacc

SEQ ID NO: 843722 - DNA, 20 bp, mouse
gcccctcggcaaccagaggc

SEQ ID NO: 843723 - DNA, 20 bp, mouse
ggcggagtttagggaagcag

SEQ ID NO: 843724 - DNA, 20 bp, mouse
gctctcgtgctaggcaccct

SEQ ID NO: 843725 - DNA, 20 bp, mouse
gcacgtgcgcgcgcagcttt

SEQ ID NO: 843726 - DNA, 20 bp, mouse
ggggcccagagcactaccta

SEQ ID NO: 843727 - DNA, 20 bp, mouse
ggcgagggagaggacgccct

SEQ ID NO: 843728 - DNA, 20 bp, mouse
ggcagctgtcagtggcccca

SEQ ID NO: 843729 - DNA, 20 bp, mouse
ggcccccgcccgctccgtta

SEQ ID NO: 843730 - DNA, 20 bp, mouse
gagcgggccggcctggccgg

SEQ ID NO: 843731 - DNA, 20 bp, mouse
gttagggcgtcgggcgccgt

SEQ ID NO: 843732 - DNA, 20 bp, mouse
gtcagaatgcggggactaga

SEQ ID NO: 843733 - DNA, 20 bp, mouse
gcctggccggtggctgccgt

SEQ ID NO: 843734 - DNA, 20 bp, mouse
gggcagcgggccggcctggc

SEQ ID NO: 843735 - DNA, 20 bp, mouse
gcaggcgggcgcctggggcg

SEQ ID NO: 843736 - DNA, 20 bp, mouse
gcctgtgcaggggtcctgag

SEQ ID NO: 843737 - DNA, 20 bp, mouse
ggacccctgcacaggatgag

SEQ ID NO: 843738 - DNA, 20 bp, mouse
ggggacagggcctccgggtg

SEQ ID NO: 843739 - DNA, 20 bp, mouse
gacagggcctccgggtgggg

SEQ ID NO: 843740 - DNA, 20 bp, mouse
gaggcagcgccaagcgaatt

SEQ ID NO: 843741 - DNA, 20 bp, mouse
gcggggctatggcggggaca

SEQ ID NO: 843742 - DNA, 20 bp, mouse
gcgcctctcatcctgtgcag

SEQ ID NO: 843743 - DNA, 20 bp, mouse
gatgagaggcggcgggatag

SEQ ID NO: 843744 - DNA, 20 bp, mouse
gcagcctccaccccacccgg

SEQ ID NO: 843745 - DNA, 20 bp, mouse
gtggcgctgcctgtggtggt

SEQ ID NO: 843746 - DNA, 20 bp, mouse
gggaagaggcggtacggggt

SEQ ID NO: 843747 - DNA, 20 bp, mouse
ggggcgctccggaagttaaa

SEQ ID NO: 843748 - DNA, 20 bp, mouse
ggacgaaggcacccgctcag

SEQ ID NO: 843749 - DNA, 20 bp, mouse
gtaaacggaagaggcggtac

SEQ ID NO: 843750 - DNA, 20 bp, mouse
ggcacccgctcagtgggctg

SEQ ID NO: 843751 - DNA, 20 bp, mouse
gaattccgcagcccactgag

SEQ ID NO: 843752 - DNA, 20 bp, mouse
gcgccaccaggaagcgtaaa

SEQ ID NO: 843753 - DNA, 20 bp, mouse
gtcctgaagaaagacgtcta

SEQ ID NO: 843754 - DNA, 20 bp, mouse
ggaagcgtaaacggaagagg

SEQ ID NO: 843755 - DNA, 20 bp, mouse
gatgaaagatcaacagtacg

SEQ ID NO: 843756 - DNA, 20 bp, mouse
gtccagaagaaggcatcgaa

SEQ ID NO: 843757 - DNA, 20 bp, mouse
gcgatagagctgtatggttg

SEQ ID NO: 843758 - DNA, 20 bp, mouse
ggaaaggagtcattgccgga

SEQ ID NO: 843759 - DNA, 20 bp, mouse
ggattcgcgtcactccatga

SEQ ID NO: 843760 - DNA, 20 bp, mouse
gaagggggccccttcgggaa

SEQ ID NO: 843761 - DNA, 20 bp, mouse
ggcagggaacccttcccgaa

SEQ ID NO: 843762 - DNA, 20 bp, mouse
ggtaaggcgatagagctgta

SEQ ID NO: 843763 - DNA, 20 bp, mouse
gcccgaaggggcccccttgg

SEQ ID NO: 843764 - DNA, 20 bp, mouse
gagacgctgtcaaaggggag

SEQ ID NO: 843765 - DNA, 20 bp, mouse
ggagtcattgccggaaggtg

SEQ ID NO: 843766 - DNA, 20 bp, mouse
gccctctctggacccaatga

SEQ ID NO: 843767 - DNA, 20 bp, mouse
ggggtccagagagggcataa

SEQ ID NO: 843768 - DNA, 20 bp, mouse
ggggtcatacccaagttaga

SEQ ID NO: 843769 - DNA, 20 bp, mouse
gctcaggcaaccaacctatc

SEQ ID NO: 843770 - DNA, 20 bp, mouse
gcctctggcaagtaacactc

SEQ ID NO: 843771 - DNA, 20 bp, mouse
gtgccagaggagaaactcct

SEQ ID NO: 843772 - DNA, 20 bp, mouse
gggatcactgcctgataggt

SEQ ID NO: 843773 - DNA, 20 bp, mouse
gccccaaggagtttctcctc

SEQ ID NO: 843774 - DNA, 20 bp, mouse
gtaacttgggtatgacccca

SEQ ID NO: 843775 - DNA, 20 bp, mouse
ggcataaggggcaggtcatt

SEQ ID NO: 843776 - DNA, 20 bp, mouse
ggtcctacgggcagcaggga

SEQ ID NO: 843777 - DNA, 20 bp, mouse
gtgccctccctgctgcccgt

SEQ ID NO: 843778 - DNA, 20 bp, mouse
gggcggggactggggtgtcg

SEQ ID NO: 843779 - DNA, 20 bp, mouse
gatggactggagtgagagcg

SEQ ID NO: 843780 - DNA, 20 bp, mouse
ggccgcccagggttctcttc

SEQ ID NO: 843781 - DNA, 20 bp, mouse
gtgctactgcgtcgcaacag

SEQ ID NO: 843782 - DNA, 20 bp, mouse
gggtcacgtggttctcaata

SEQ ID NO: 843783 - DNA, 20 bp, mouse
gactgctctagcaatcgtct

SEQ ID NO: 843784 - DNA, 20 bp, mouse
gtctcaatatggcgccgccc

SEQ ID NO: 843785 - DNA, 20 bp, mouse
gggcgtgtgactaaaatgtt

SEQ ID NO: 843786 - DNA, 20 bp, mouse
gaccggcgacatggcatcta

SEQ ID NO: 843787 - DNA, 20 bp, mouse
gggaaggaacgcagacggat

SEQ ID NO: 843788 - DNA, 20 bp, mouse
gcggcgcgactagaaagctc

SEQ ID NO: 843789 - DNA, 20 bp, mouse
gagtaagcacaaggtctccg

SEQ ID NO: 843790 - DNA, 20 bp, mouse
gctaaattgcttcctccttg

SEQ ID NO: 843791 - DNA, 20 bp, mouse
gcgcgcaggcgcagtgtgac

SEQ ID NO: 843792 - DNA, 20 bp, mouse
gctccggggttgagtcccac

SEQ ID NO: 843793 - DNA, 20 bp, mouse
gtctagtcgcgccggatccg

SEQ ID NO: 843794 - DNA, 20 bp, mouse
gctctctctaagccgactcg

SEQ ID NO: 843795 - DNA, 20 bp, mouse
gagtcggcttagagagagtc

SEQ ID NO: 843796 - DNA, 20 bp, mouse
gaccagtggcagatagagaa

SEQ ID NO: 843797 - DNA, 20 bp, mouse
gtctctggctagccactgtc

SEQ ID NO: 843798 - DNA, 20 bp, mouse
gaagccctctgtcactgata

SEQ ID NO: 843799 - DNA, 20 bp, mouse
ggtgttctgggacataccag

SEQ ID NO: 843800 - DNA, 20 bp, mouse
gagaacacaccatgtgtctc

SEQ ID NO: 843801 - DNA, 20 bp, mouse
gactgtctggcatagacact

SEQ ID NO: 843802 - DNA, 20 bp, mouse
gtctgtcactgataaggctg

SEQ ID NO: 843803 - DNA, 20 bp, mouse
gttcctaaagggcttatgag

SEQ ID NO: 843804 - DNA, 20 bp, mouse
ggtcttgcatgtattctcac

SEQ ID NO: 843805 - DNA, 20 bp, mouse
gggctctcacttgcctttcc

SEQ ID NO: 843806 - DNA, 20 bp, mouse
gggaacccacactggggcga

SEQ ID NO: 843807 - DNA, 20 bp, mouse
ggacctgtggaacccacact

SEQ ID NO: 843808 - DNA, 20 bp, mouse
gcagtggagcttaggacgga

SEQ ID NO: 843809 - DNA, 20 bp, mouse
gctggggcgacggagtgatc

SEQ ID NO: 843810 - DNA, 20 bp, mouse
ggccaccgcctgtgcggtaa

SEQ ID NO: 843811 - DNA, 20 bp, mouse
gaaacagacccgcagacctg

SEQ ID NO: 843812 - DNA, 20 bp, mouse
ggccccagtgtgggttccac

SEQ ID NO: 843813 - DNA, 20 bp, mouse
gtggagcttaggacggacgg

SEQ ID NO: 843814 - DNA, 20 bp, mouse
ggcggggcctggcgacccgg

SEQ ID NO: 843815 - DNA, 20 bp, mouse
ggtgcggtaaaggctgtagg

SEQ ID NO: 843816 - DNA, 20 bp, mouse
gcagaggcgaggtgaacaag

SEQ ID NO: 843817 - DNA, 20 bp, mouse
ggcggcagaaaaacgagaac

SEQ ID NO: 843818 - DNA, 20 bp, mouse
gtagcagggcggacctcgga

SEQ ID NO: 843819 - DNA, 20 bp, mouse
gggaatgcaatgaccggcga

SEQ ID NO: 843820 - DNA, 20 bp, mouse
gggacataatcggctgttca

SEQ ID NO: 843821 - DNA, 20 bp, mouse
gaattctcgccggacataat

SEQ ID NO: 843822 - DNA, 20 bp, mouse
ggaggggaaggacctcactc

SEQ ID NO: 843823 - DNA, 20 bp, mouse
ggtcgccagcgggcgatgat

SEQ ID NO: 843824 - DNA, 20 bp, mouse
gccaaccgcgacgtcgccag

SEQ ID NO: 843825 - DNA, 20 bp, mouse
gggtccgccctgctacgctt

SEQ ID NO: 843826 - DNA, 20 bp, mouse
gtgggtacgtgagtggtcgc

SEQ ID NO: 843827 - DNA, 20 bp, mouse
gagtggtcgcaggctctgaa

SEQ ID NO: 843828 - DNA, 20 bp, mouse
gatgcccgctagagcggatg

SEQ ID NO: 843829 - DNA, 20 bp, mouse
ggaaacagacggtatccttg

SEQ ID NO: 843830 - DNA, 20 bp, mouse
gcgtcggctgggcgggtcga

SEQ ID NO: 843831 - DNA, 20 bp, mouse
gaaaacaaaggcctctagcg

SEQ ID NO: 843832 - DNA, 20 bp, mouse
gcctgcggccatgttggtga

SEQ ID NO: 843833 - DNA, 20 bp, mouse
ggcctctagcgaggtcccca

SEQ ID NO: 843834 - DNA, 20 bp, mouse
ggctccgcctaccacaagga

SEQ ID NO: 843835 - DNA, 20 bp, mouse
gcggaagtgtggcagctcgg

SEQ ID NO: 843836 - DNA, 20 bp, mouse
ggccgcgcggcaggagggga

SEQ ID NO: 843837 - DNA, 20 bp, mouse
gcaaacagtggggtcatgtg

SEQ ID NO: 843838 - DNA, 20 bp, mouse
ggcggcagctgcaggagtag

SEQ ID NO: 843839 - DNA, 20 bp, mouse
gcggcggcggcgagcgctca

SEQ ID NO: 843840 - DNA, 20 bp, mouse
gtcgcaccgcccggagccgg

SEQ ID NO: 843841 - DNA, 20 bp, mouse
gcgggagagggcaggcccta

SEQ ID NO: 843842 - DNA, 20 bp, mouse
gtccgggcggtgcgaggctc

SEQ ID NO: 843843 - DNA, 20 bp, mouse
gggcccgccgcacgcggcct

SEQ ID NO: 843844 - DNA, 20 bp, mouse
gatcacggggacaaacagtg

SEQ ID NO: 843845 - DNA, 20 bp, mouse
gacagcgcgcgcgttcccta

SEQ ID NO: 843846 - DNA, 20 bp, mouse
gcgtgtggatgtgctaatgg

SEQ ID NO: 843847 - DNA, 20 bp, mouse
gacacagggcagtaggggtc

SEQ ID NO: 843848 - DNA, 20 bp, mouse
gaatggtggcttagttagtg

SEQ ID NO: 843849 - DNA, 20 bp, mouse
gagggaggcaggtcctgtcc

SEQ ID NO: 843850 - DNA, 20 bp, mouse
ggtggcttagttagtgaggc

SEQ ID NO: 843851 - DNA, 20 bp, mouse
gcagttcagccgggcggccc

SEQ ID NO: 843852 - DNA, 20 bp, mouse
ggaggagacacagggcagta

SEQ ID NO: 843853 - DNA, 20 bp, mouse
gcccggctgaactgcaggac

SEQ ID NO: 843854 - DNA, 20 bp, mouse
ggaaaagaagcctcgtcgtg

SEQ ID NO: 843855 - DNA, 20 bp, mouse
gttaagatggaggagacaca

SEQ ID NO: 843856 - DNA, 20 bp, mouse
gtccctatattgggcttcaa

SEQ ID NO: 843857 - DNA, 20 bp, mouse
gtgagctgcacaccggggaa

SEQ ID NO: 843858 - DNA, 20 bp, mouse
gccgcccaggagcttcccct

SEQ ID NO: 843859 - DNA, 20 bp, mouse
gacagtgggtccagaggagc

SEQ ID NO: 843860 - DNA, 20 bp, mouse
gacgaataatgtgtgagggt

SEQ ID NO: 843861 - DNA, 20 bp, mouse
gtggagaggcaattctgatc

SEQ ID NO: 843862 - DNA, 20 bp, mouse
gagcacccggagttctgtct

SEQ ID NO: 843863 - DNA, 20 bp, mouse
ggctccaaaagcgcccactc

SEQ ID NO: 843864 - DNA, 20 bp, mouse
gagggctgcaacgccagagt

SEQ ID NO: 843865 - DNA, 20 bp, mouse
gagcccttgaagcccaatat

SEQ ID NO: 843866 - DNA, 20 bp, mouse
ggggcctggcagggtattac

SEQ ID NO: 843867 - DNA, 20 bp, mouse
gggctccttcctcccaaaga

SEQ ID NO: 843868 - DNA, 20 bp, mouse
gaaggaaccagggactaatg

SEQ ID NO: 843869 - DNA, 20 bp, mouse
gtggcagccccattagtccc

SEQ ID NO: 843870 - DNA, 20 bp, mouse
gtataagacagcaactatat

SEQ ID NO: 843871 - DNA, 20 bp, mouse
gaggacagaaatgacaactt

SEQ ID NO: 843872 - DNA, 20 bp, mouse
gtcaagctggtacagtggga

SEQ ID NO: 843873 - DNA, 20 bp, mouse
gtagtccctggttccttctc

SEQ ID NO: 843874 - DNA, 20 bp, mouse
ggttctgcatgttccctctt

SEQ ID NO: 843875 - DNA, 20 bp, mouse
ggttagagcaggatgtcctg

SEQ ID NO: 843876 - DNA, 20 bp, mouse
ggccaaaagtggcccgggag

SEQ ID NO: 843877 - DNA, 20 bp, mouse
gaaaatggaaggtttggcct

SEQ ID NO: 843878 - DNA, 20 bp, mouse
ggagcgagtcctggtgaaca

SEQ ID NO: 843879 - DNA, 20 bp, mouse
gcggcttcctccagaacggg

SEQ ID NO: 843880 - DNA, 20 bp, mouse
gcatcctcctcccgttctgg

SEQ ID NO: 843881 - DNA, 20 bp, mouse
ggaaggtttggcctcgggta

SEQ ID NO: 843882 - DNA, 20 bp, mouse
ggatactgatatctttagag

SEQ ID NO: 843883 - DNA, 20 bp, mouse
gctggaggaagccggcatcc

SEQ ID NO: 843884 - DNA, 20 bp, mouse
gcccccctaccctgatcaca

SEQ ID NO: 843885 - DNA, 20 bp, mouse
gtgtccatgtgatcagggta

SEQ ID NO: 843886 - DNA, 20 bp, mouse
gcaatcgcacgcgcagaaca

SEQ ID NO: 843887 - DNA, 20 bp, mouse
gacgagcgtaggtaagacca

SEQ ID NO: 843888 - DNA, 20 bp, mouse
gacgagtcgcgtggagctgt

SEQ ID NO: 843889 - DNA, 20 bp, mouse
ggctacttccgttctgacgt

SEQ ID NO: 843890 - DNA, 20 bp, mouse
ggcgactcgtccacgagcgt

SEQ ID NO: 843891 - DNA, 20 bp, mouse
gcccaccgccgcatacctca

SEQ ID NO: 843892 - DNA, 20 bp, mouse
gggtctgacgccggctgaaa

SEQ ID NO: 843893 - DNA, 20 bp, mouse
gggctgaaacgggaagtaga

SEQ ID NO: 843894 - DNA, 20 bp, mouse
ggctgatgacacgggagctt

SEQ ID NO: 843895 - DNA, 20 bp, mouse
gtgtcggtcgcgtgcgggga

SEQ ID NO: 843896 - DNA, 20 bp, mouse
gggcgtgcccaagtggtggg

SEQ ID NO: 843897 - DNA, 20 bp, mouse
gcgaagggcgaaggcaaaag

SEQ ID NO: 843898 - DNA, 20 bp, mouse
gagcaggcctcccaccactt

SEQ ID NO: 843899 - DNA, 20 bp, mouse
ggggacgtggcgttacgtgg

SEQ ID NO: 843900 - DNA, 20 bp, mouse
gtaggcgtggcctgtggggc

SEQ ID NO: 843901 - DNA, 20 bp, mouse
gagggggcgtgcccaagtgg

SEQ ID NO: 843902 - DNA, 20 bp, mouse
gagagcctcgggagccgact

SEQ ID NO: 843903 - DNA, 20 bp, mouse
ggggcagggctgcgaccacg

SEQ ID NO: 843904 - DNA, 20 bp, mouse
gcctgcccagtcggctcccg

SEQ ID NO: 843905 - DNA, 20 bp, mouse
gtgggcgtggcctgcggccc

SEQ ID NO: 843906 - DNA, 20 bp, mouse
gcccccggcacgctcggctc

SEQ ID NO: 843907 - DNA, 20 bp, mouse
gctcgcgcgggtcctcgcag

SEQ ID NO: 843908 - DNA, 20 bp, mouse
gcccgcccgcgccagcgtcg

SEQ ID NO: 843909 - DNA, 20 bp, mouse
gcgcgaccgcccctcgcccc

SEQ ID NO: 843910 - DNA, 20 bp, mouse
gcggctggaggtggcgtcca

SEQ ID NO: 843911 - DNA, 20 bp, mouse
ggaacccgttaggccccggg

SEQ ID NO: 843912 - DNA, 20 bp, mouse
gccctcgcccccggcacgct

SEQ ID NO: 843913 - DNA, 20 bp, mouse
gggaacggtagttcctcccg

SEQ ID NO: 843914 - DNA, 20 bp, mouse
gcggcacgggcagctcgcgc

SEQ ID NO: 843915 - DNA, 20 bp, mouse
gttaaactgcagaacccgtt

SEQ ID NO: 843916 - DNA, 20 bp, mouse
ggggctgcaaggtggagttc

SEQ ID NO: 843917 - DNA, 20 bp, mouse
gccaggcgagggcgtgagga

SEQ ID NO: 843918 - DNA, 20 bp, mouse
ggcaaggtggagttccggag

SEQ ID NO: 843919 - DNA, 20 bp, mouse
ggggcggctgctccaggcga

SEQ ID NO: 843920 - DNA, 20 bp, mouse
ggagcgcgctccatagggta

SEQ ID NO: 843921 - DNA, 20 bp, mouse
gtgctccaggcgagggcgtg

SEQ ID NO: 843922 - DNA, 20 bp, mouse
gactccaccttgcagcccca

SEQ ID NO: 843923 - DNA, 20 bp, mouse
gcagaagagcgcgctccata

SEQ ID NO: 843924 - DNA, 20 bp, mouse
gacgccgcctggctctcccg

SEQ ID NO: 843925 - DNA, 20 bp, mouse
gctggggacagaagggtcgc

SEQ ID NO: 843926 - DNA, 20 bp, mouse
ggagccccccaacaatcagg

SEQ ID NO: 843927 - DNA, 20 bp, mouse
gtctctgcaaccaataccag

SEQ ID NO: 843928 - DNA, 20 bp, mouse
gaggggttaactctcttgtt

SEQ ID NO: 843929 - DNA, 20 bp, mouse
gtagccccctgattgttggg

SEQ ID NO: 843930 - DNA, 20 bp, mouse
gaatccggaagtgccagttg

SEQ ID NO: 843931 - DNA, 20 bp, mouse
gaacctctggcctccaccaa

SEQ ID NO: 843932 - DNA, 20 bp, mouse
gaccaggtgaaatggtcctt

SEQ ID NO: 843933 - DNA, 20 bp, mouse
ggcagtagccccctgattgt

SEQ ID NO: 843934 - DNA, 20 bp, mouse
ggaaattgggtggtggtctg

SEQ ID NO: 843935 - DNA, 20 bp, mouse
gtcaccatttggcggaaatt

SEQ ID NO: 843936 - DNA, 20 bp, mouse
gaaggacgctgcccggtcgt

SEQ ID NO: 843937 - DNA, 20 bp, mouse
ggtgccccgccctcccacgg

SEQ ID NO: 843938 - DNA, 20 bp, mouse
gtgggagggcggggcaccat

SEQ ID NO: 843939 - DNA, 20 bp, mouse
gtgagcgcccgcggcgacga

SEQ ID NO: 843940 - DNA, 20 bp, mouse
gcatgggcgtggcacagctg

SEQ ID NO: 843941 - DNA, 20 bp, mouse
gcccggtcgtcggggcggta

SEQ ID NO: 843942 - DNA, 20 bp, mouse
gggcgcgggccctgaggcgg

SEQ ID NO: 843943 - DNA, 20 bp, mouse
gggcgtggcacagctgcggt

SEQ ID NO: 843944 - DNA, 20 bp, mouse
gacaccccgcccagcgcgct

SEQ ID NO: 843945 - DNA, 20 bp, mouse
ggtgctgtgagcggcttccc

SEQ ID NO: 843946 - DNA, 20 bp, mouse
gggggagggggatgccgcga

SEQ ID NO: 843947 - DNA, 20 bp, mouse
gtggggacccggggcctccc

SEQ ID NO: 843948 - DNA, 20 bp, mouse
gcgacccgccatggcccctc

SEQ ID NO: 843949 - DNA, 20 bp, mouse
gcagccgcagcgccggggag

SEQ ID NO: 843950 - DNA, 20 bp, mouse
gcacgcctcccgacccgcca

SEQ ID NO: 843951 - DNA, 20 bp, mouse
ggggtcgggaggcgtgcgtg

SEQ ID NO: 843952 - DNA, 20 bp, mouse
gcatccccgaggggccatgg

SEQ ID NO: 843953 - DNA, 20 bp, mouse
gcctccccatagatcggaaa

SEQ ID NO: 843954 - DNA, 20 bp, mouse
gccagctgcagcgtcaggcg

SEQ ID NO: 843955 - DNA, 20 bp, mouse
ggagggggatgccgcgaggg

SEQ ID NO: 843956 - DNA, 20 bp, mouse
gaagccaccgcggggaggtg

SEQ ID NO: 843957 - DNA, 20 bp, mouse
gccaccgcggggaggtgcgg

SEQ ID NO: 843958 - DNA, 20 bp, mouse
ggggaaggactgacgttgtg

SEQ ID NO: 843959 - DNA, 20 bp, mouse
gccagtggccggtttgaatg

SEQ ID NO: 843960 - DNA, 20 bp, mouse
ggggagagcagcacggggca

SEQ ID NO: 843961 - DNA, 20 bp, mouse
gctccccgcggtggcttctt

SEQ ID NO: 843962 - DNA, 20 bp, mouse
gtgggggggagaagctctag

SEQ ID NO: 843963 - DNA, 20 bp, mouse
ggggagaagctctaggggcg

SEQ ID NO: 843964 - DNA, 20 bp, mouse
gaggactgacgttgtggggg

SEQ ID NO: 843965 - DNA, 20 bp, mouse
gaggggcataaaggggggga

SEQ ID NO: 843966 - DNA, 20 bp, mouse
ggggcgtgcggggacccgag

SEQ ID NO: 843967 - DNA, 20 bp, mouse
ggagaaccgtgcaaactcag

SEQ ID NO: 843968 - DNA, 20 bp, mouse
gggcggctgcggcaagaaaa

SEQ ID NO: 843969 - DNA, 20 bp, mouse
gcggcaggtctgtaccaaat

SEQ ID NO: 843970 - DNA, 20 bp, mouse
gccgtgctgcggggcgtgcg

SEQ ID NO: 843971 - DNA, 20 bp, mouse
gagtgaacccgcaaaaacat

SEQ ID NO: 843972 - DNA, 20 bp, mouse
ggcgaccacgccgtgctgcg

SEQ ID NO: 843973 - DNA, 20 bp, mouse
gaccaaatggggcgcgaggg

SEQ ID NO: 843974 - DNA, 20 bp, mouse
gcacgccccgcagcacggcg

SEQ ID NO: 843975 - DNA, 20 bp, mouse
gtgtaccaaatggggcgcga

SEQ ID NO: 843976 - DNA, 20 bp, mouse
gctcctagggagtggatgac

SEQ ID NO: 843977 - DNA, 20 bp, mouse
ggctcggcctcccttggggt

SEQ ID NO: 843978 - DNA, 20 bp, mouse
ggacccgtcatccactccct

SEQ ID NO: 843979 - DNA, 20 bp, mouse
gtcccttggggtgggtgcgt

SEQ ID NO: 843980 - DNA, 20 bp, mouse
ggatgacgggtcctggccct

SEQ ID NO: 843981 - DNA, 20 bp, mouse
gtcccacgcacccaccccaa

SEQ ID NO: 843982 - DNA, 20 bp, mouse
gaaatggctcggcctccctt

SEQ ID NO: 843983 - DNA, 20 bp, mouse
gtaacactgcagtgaacacg

SEQ ID NO: 843984 - DNA, 20 bp, mouse
gggtcagcaaggtgaaggct

SEQ ID NO: 843985 - DNA, 20 bp, mouse
gttaagagaggtagccatga

SEQ ID NO: 843986 - DNA, 20 bp, mouse
ggcaaaagggaaggaaaacc

SEQ ID NO: 843987 - DNA, 20 bp, mouse
gaaagaaagggcaaaaggga

SEQ ID NO: 843988 - DNA, 20 bp, mouse
ggaagaaagaaagggcaaaa

SEQ ID NO: 843989 - DNA, 20 bp, mouse
gcttaagtttgggttttatt

SEQ ID NO: 843990 - DNA, 20 bp, mouse
gggtaatgggaactcttgta

SEQ ID NO: 843991 - DNA, 20 bp, mouse
gtcctaggtgtcttaagttt

SEQ ID NO: 843992 - DNA, 20 bp, mouse
ggtgtggttagcaaggtaat

SEQ ID NO: 843993 - DNA, 20 bp, mouse
gaccacacccaacttgtgag

SEQ ID NO: 843994 - DNA, 20 bp, mouse
ggacaagcctctcacaagtt

SEQ ID NO: 843995 - DNA, 20 bp, mouse
ggggaaggaaaaccaggcct

SEQ ID NO: 843996 - DNA, 20 bp, mouse
ggctccaatgtcttaagctt

SEQ ID NO: 843997 - DNA, 20 bp, mouse
ggtgtgggttagcaaggtaa

SEQ ID NO: 843998 - DNA, 20 bp, mouse
gaaacccaagcttaagacat

SEQ ID NO: 843999 - DNA, 20 bp, mouse
ggcttaagacattggagcaa

SEQ ID NO: 844000 - DNA, 20 bp, mouse
ggtttatactggttctgtgt

SEQ ID NO: 844001 - DNA, 20 bp, mouse
gaaggtaatggaaacttgta

SEQ ID NO: 844002 - DNA, 20 bp, mouse
gggttttgtaactttatttc

SEQ ID NO: 844003 - DNA, 20 bp, mouse
gggttctgtgtgggttagca

SEQ ID NO: 844004 - DNA, 20 bp, mouse
gtcaattcctctatttgaca

SEQ ID NO: 844005 - DNA, 20 bp, mouse
gcacaaaactgaagtataaa

SEQ ID NO: 844006 - DNA, 20 bp, mouse
gaatctatctgctacagaga

SEQ ID NO: 844007 - DNA, 20 bp, mouse
ggcagatagattttcagtca

SEQ ID NO: 844008 - DNA, 20 bp, mouse
gttaagcttgggtcttactt

SEQ ID NO: 844009 - DNA, 20 bp, mouse
gctatctgctacagagaagg

SEQ ID NO: 844010 - DNA, 20 bp, mouse
gattttcagtcaaggtcata

SEQ ID NO: 844011 - DNA, 20 bp, mouse
ggtaggcgtggtcacagaac

SEQ ID NO: 844012 - DNA, 20 bp, mouse
ggaaattggagctaaaatca

SEQ ID NO: 844013 - DNA, 20 bp, mouse
gggtaatgggaacacttgta

SEQ ID NO: 844014 - DNA, 20 bp, mouse
gatgtggttagcaaggtaat

SEQ ID NO: 844015 - DNA, 20 bp, mouse
gatgaaagaaaaccaggcct

SEQ ID NO: 844016 - DNA, 20 bp, mouse
gtggactgcgggttctgtag

SEQ ID NO: 844017 - DNA, 20 bp, mouse
gggtgtaggcgactggactg

SEQ ID NO: 844018 - DNA, 20 bp, mouse
gcgaaactcaggcaccgggc

SEQ ID NO: 844019 - DNA, 20 bp, mouse
gccaaaggaaagcgaaactc

SEQ ID NO: 844020 - DNA, 20 bp, mouse
ggacctggcccggtaactcc

SEQ ID NO: 844021 - DNA, 20 bp, mouse
ggcttgtcgtgtcctggtgt

SEQ ID NO: 844022 - DNA, 20 bp, mouse
ggaaagcttggcggtgaggg

SEQ ID NO: 844023 - DNA, 20 bp, mouse
gactaactcaggacgacaaa

SEQ ID NO: 844024 - DNA, 20 bp, mouse
gttggccggcagtgccaggg

SEQ ID NO: 844025 - DNA, 20 bp, mouse
gagcgtatccaggagttacc

SEQ ID NO: 844026 - DNA, 20 bp, mouse
gacgcacttccggcaagagt

SEQ ID NO: 844027 - DNA, 20 bp, mouse
gtatacacgccatcagctgt

SEQ ID NO: 844028 - DNA, 20 bp, mouse
gtgaagggcagctttgggga

SEQ ID NO: 844029 - DNA, 20 bp, mouse
gcggaagtgcgtcatcagct

SEQ ID NO: 844030 - DNA, 20 bp, mouse
gtagctacggctacgggagg

SEQ ID NO: 844031 - DNA, 20 bp, mouse
ggtgccctccagctctagaa

SEQ ID NO: 844032 - DNA, 20 bp, mouse
ggcgacaaggctaggcccta

SEQ ID NO: 844033 - DNA, 20 bp, mouse
gcaaagcggcccagctggat

SEQ ID NO: 844034 - DNA, 20 bp, mouse
gaccagcagaggccgagcac

SEQ ID NO: 844035 - DNA, 20 bp, mouse
ggggcgggagctagaaaggt

SEQ ID NO: 844036 - DNA, 20 bp, mouse
gagacgcgggaaccctactg

SEQ ID NO: 844037 - DNA, 20 bp, mouse
gggaccccagagattgtctg

SEQ ID NO: 844038 - DNA, 20 bp, mouse
ggccccagggtcatcggctt

SEQ ID NO: 844039 - DNA, 20 bp, mouse
ggcggggcgtggtccgggtc

SEQ ID NO: 844040 - DNA, 20 bp, mouse
gcggacgccggcgaggtcgc

SEQ ID NO: 844041 - DNA, 20 bp, mouse
gtgtccctagggtctcaaaa

SEQ ID NO: 844042 - DNA, 20 bp, mouse
ggtccgcgtgccaactcccg

SEQ ID NO: 844043 - DNA, 20 bp, mouse
gcccaaagccgatgaccctg

SEQ ID NO: 844044 - DNA, 20 bp, mouse
gttcgccccgccccgggagt

SEQ ID NO: 844045 - DNA, 20 bp, mouse
gctaacactggccggcccag

SEQ ID NO: 844046 - DNA, 20 bp, mouse
gggcccagaaaggacctccc

SEQ ID NO: 844047 - DNA, 20 bp, mouse
ggcaaacgcggggtgtggtt

SEQ ID NO: 844048 - DNA, 20 bp, mouse
ggggtggcgccgatttcccg

SEQ ID NO: 844049 - DNA, 20 bp, mouse
gtaggcagaaaaagagtcta

SEQ ID NO: 844050 - DNA, 20 bp, mouse
ggcgcatctcccaggtaacc

SEQ ID NO: 844051 - DNA, 20 bp, mouse
gtacctgggagatgcgcgcc

SEQ ID NO: 844052 - DNA, 20 bp, mouse
ggtgacgcaaacgcggggtg

SEQ ID NO: 844053 - DNA, 20 bp, mouse
gggaaatcggcgccacccag

SEQ ID NO: 844054 - DNA, 20 bp, mouse
gggccggcccgggcgcaatg

SEQ ID NO: 844055 - DNA, 20 bp, mouse
gggtggcgcaaggaaagaag

SEQ ID NO: 844056 - DNA, 20 bp, mouse
gcaagcatgccgggagtcgg

SEQ ID NO: 844057 - DNA, 20 bp, mouse
gcccggtaccgccctctagt

SEQ ID NO: 844058 - DNA, 20 bp, mouse
ggtcacagcctactagaggg

SEQ ID NO: 844059 - DNA, 20 bp, mouse
gggtgagcatggttactcga

SEQ ID NO: 844060 - DNA, 20 bp, mouse
ggggagtggccgtgctgctg

SEQ ID NO: 844061 - DNA, 20 bp, mouse
gactcgatgggcgtggtcga

SEQ ID NO: 844062 - DNA, 20 bp, mouse
gcggccactcccccgactcc

SEQ ID NO: 844063 - DNA, 20 bp, mouse
ggagcctatgccaggagcgg

SEQ ID NO: 844064 - DNA, 20 bp, mouse
gtctgcgcgccggaagagag

SEQ ID NO: 844065 - DNA, 20 bp, mouse
ggcggtaccgggcacgccgg

SEQ ID NO: 844066 - DNA, 20 bp, mouse
gaggcagggcctgaaactag

SEQ ID NO: 844067 - DNA, 20 bp, mouse
ggagtcgaaaagtaacggaa

SEQ ID NO: 844068 - DNA, 20 bp, mouse
ggaccatatatgactgggtg

SEQ ID NO: 844069 - DNA, 20 bp, mouse
gaagcgccgaggaggtaggt

SEQ ID NO: 844070 - DNA, 20 bp, mouse
ggtgtcggtcggggagccgt

SEQ ID NO: 844071 - DNA, 20 bp, mouse
gtaaagaccaccatcaggca

SEQ ID NO: 844072 - DNA, 20 bp, mouse
gaaactagtggttctaaagt

SEQ ID NO: 844073 - DNA, 20 bp, mouse
gggctccccgaccgacacca

SEQ ID NO: 844074 - DNA, 20 bp, mouse
ggggtggggagatccctagt

SEQ ID NO: 844075 - DNA, 20 bp, mouse
gcgggctcacgcaagcgccg

SEQ ID NO: 844076 - DNA, 20 bp, mouse
ggagccagcgggcgagagga

SEQ ID NO: 844077 - DNA, 20 bp, mouse
gcaccaatggtgtgacgcga

SEQ ID NO: 844078 - DNA, 20 bp, mouse
gcgagaggagggctgatagg

SEQ ID NO: 844079 - DNA, 20 bp, mouse
gggaaaggataacgtcaccc

SEQ ID NO: 844080 - DNA, 20 bp, mouse
gggctccagagaaaagccga

SEQ ID NO: 844081 - DNA, 20 bp, mouse
gacagggcggagctgtccgc

SEQ ID NO: 844082 - DNA, 20 bp, mouse
ggcctcgggttgggtcaaca

SEQ ID NO: 844083 - DNA, 20 bp, mouse
gaagccgaaggcctcgggtt

SEQ ID NO: 844084 - DNA, 20 bp, mouse
gcgccctcgcgtcacaccat

SEQ ID NO: 844085 - DNA, 20 bp, mouse
gaccctgttgacccaacccg

SEQ ID NO: 844086 - DNA, 20 bp, mouse
ggggaagagtcacctgcgat

SEQ ID NO: 844087 - DNA, 20 bp, mouse
gcgaacgtgtctgaggtgag

SEQ ID NO: 844088 - DNA, 20 bp, mouse
gcgtgcgccgaacgtgtctg

SEQ ID NO: 844089 - DNA, 20 bp, mouse
gccggggacctcagcgacac

SEQ ID NO: 844090 - DNA, 20 bp, mouse
ggatctgggcacccgtctgt

SEQ ID NO: 844091 - DNA, 20 bp, mouse
gtgtctgaggtgagaggccg

SEQ ID NO: 844092 - DNA, 20 bp, mouse
ggagaaggctggagggtcga

SEQ ID NO: 844093 - DNA, 20 bp, mouse
ggacactcgtgtcccatcgc

SEQ ID NO: 844094 - DNA, 20 bp, mouse
gtgggacacgagtgtcgtca

SEQ ID NO: 844095 - DNA, 20 bp, mouse
gcgtctgtgggcggcgagga

SEQ ID NO: 844096 - DNA, 20 bp, mouse
gacccgcgggagcggaagga

SEQ ID NO: 844097 - DNA, 20 bp, mouse
ggcgctgagaggagcttaga

SEQ ID NO: 844098 - DNA, 20 bp, mouse
gctcccgcgggtcacaatgt

SEQ ID NO: 844099 - DNA, 20 bp, mouse
gctgagaggagcttagacgg

SEQ ID NO: 844100 - DNA, 20 bp, mouse
gcgggtcacaatgtagggtt

SEQ ID NO: 844101 - DNA, 20 bp, mouse
gaccccccgacccccagtcg

SEQ ID NO: 844102 - DNA, 20 bp, mouse
gtcacaatgtagggttagga

SEQ ID NO: 844103 - DNA, 20 bp, mouse
gcggagggcggggcccacca

SEQ ID NO: 844104 - DNA, 20 bp, mouse
ggaggagcttagacggaggg

SEQ ID NO: 844105 - DNA, 20 bp, mouse
gggggcggtgaccgcggcga

SEQ ID NO: 844106 - DNA, 20 bp, mouse
gagaacccccaacagtcaga

SEQ ID NO: 844107 - DNA, 20 bp, mouse
gaggagtaagtatctagggt

SEQ ID NO: 844108 - DNA, 20 bp, mouse
gaatgaggagtaagtatcta

SEQ ID NO: 844109 - DNA, 20 bp, mouse
gttgggggttctaagaactg

SEQ ID NO: 844110 - DNA, 20 bp, mouse
gcacggatctagattggttg

SEQ ID NO: 844111 - DNA, 20 bp, mouse
ggacccccacggatctagat

SEQ ID NO: 844112 - DNA, 20 bp, mouse
gctaacggctgagtcagaaa

SEQ ID NO: 844113 - DNA, 20 bp, mouse
ggtggctaagaagattgaca

SEQ ID NO: 844114 - DNA, 20 bp, mouse
gtcaagatgcaaccattata

SEQ ID NO: 844115 - DNA, 20 bp, mouse
gtgtcatccttctgactgtt

SEQ ID NO: 844116 - DNA, 20 bp, mouse
gtcggcgggagcattcccgg

SEQ ID NO: 844117 - DNA, 20 bp, mouse
ggacctggggtgtccccgtc

SEQ ID NO: 844118 - DNA, 20 bp, mouse
gccaccgcgctccctcagtc

SEQ ID NO: 844119 - DNA, 20 bp, mouse
ggtgtccccgtccggactga

SEQ ID NO: 844120 - DNA, 20 bp, mouse
gactcctccccctgctcgtg

SEQ ID NO: 844121 - DNA, 20 bp, mouse
ggagtcgcagccagtggagg

SEQ ID NO: 844122 - DNA, 20 bp, mouse
gggaagcaggcgacgccccc

SEQ ID NO: 844123 - DNA, 20 bp, mouse
gcgctccctcagtccggacg

SEQ ID NO: 844124 - DNA, 20 bp, mouse
gtgtggcagctggacccaaa

SEQ ID NO: 844125 - DNA, 20 bp, mouse
gcgcgggggccacgcagacc

SEQ ID NO: 844126 - DNA, 20 bp, mouse
gccgcaagatgggtgggagt

SEQ ID NO: 844127 - DNA, 20 bp, mouse
gagcctctgccgcgtgctgt

SEQ ID NO: 844128 - DNA, 20 bp, mouse
ggcgcaagccgcaagatggg

SEQ ID NO: 844129 - DNA, 20 bp, mouse
gcacccacagcacgcggcag

SEQ ID NO: 844130 - DNA, 20 bp, mouse
gatccagcgaacgccgtggg

SEQ ID NO: 844131 - DNA, 20 bp, mouse
gggtgggagtcggctggcgg

SEQ ID NO: 844132 - DNA, 20 bp, mouse
gtgggtggggcatgtaggcg

SEQ ID NO: 844133 - DNA, 20 bp, mouse
gtgggcggagccttgggaga

SEQ ID NO: 844134 - DNA, 20 bp, mouse
ggccttgggagagggaacct

SEQ ID NO: 844135 - DNA, 20 bp, mouse
gggaacctcggctgtgtggg

SEQ ID NO: 844136 - DNA, 20 bp, mouse
gagagaagactaaaagctga

SEQ ID NO: 844137 - DNA, 20 bp, mouse
gagcacacactatcttacag

SEQ ID NO: 844138 - DNA, 20 bp, mouse
gcatctattataatgttggg

SEQ ID NO: 844139 - DNA, 20 bp, mouse
gaaaaaacaaaaacttacta

SEQ ID NO: 844140 - DNA, 20 bp, mouse
gaatgcatctattataatgt

SEQ ID NO: 844141 - DNA, 20 bp, mouse
gtgccttaagtaaaacacta

SEQ ID NO: 844142 - DNA, 20 bp, mouse
gttccatagtgttttactta

SEQ ID NO: 844143 - DNA, 20 bp, mouse
gacactatcttacagaggac

SEQ ID NO: 844144 - DNA, 20 bp, mouse
gtattataatgttgggtggg

SEQ ID NO: 844145 - DNA, 20 bp, mouse
ggaagactaaaagctgatgg

SEQ ID NO: 844146 - DNA, 20 bp, mouse
gccccgcccactgactagtg

SEQ ID NO: 844147 - DNA, 20 bp, mouse
gtgggcggggccgccggaga

SEQ ID NO: 844148 - DNA, 20 bp, mouse
gccgcccccacactagtcag

SEQ ID NO: 844149 - DNA, 20 bp, mouse
ggaagcctactgtccctggg

SEQ ID NO: 844150 - DNA, 20 bp, mouse
gcctgggggcgtaaccagca

SEQ ID NO: 844151 - DNA, 20 bp, mouse
gccccacactagtcagtggg

SEQ ID NO: 844152 - DNA, 20 bp, mouse
ggcggggcccgggctggcct

SEQ ID NO: 844153 - DNA, 20 bp, mouse
gggtcccgaccgctctgccc

SEQ ID NO: 844154 - DNA, 20 bp, mouse
ggtctcccggcgccccgctc

SEQ ID NO: 844155 - DNA, 20 bp, mouse
gtccggagaacgtgaaaatc

SEQ ID NO: 844156 - DNA, 20 bp, mouse
gtgaacggacgacccctccc

SEQ ID NO: 844157 - DNA, 20 bp, mouse
gcggggcccggggaccactt

SEQ ID NO: 844158 - DNA, 20 bp, mouse
gggaggcggagcaaatgcga

SEQ ID NO: 844159 - DNA, 20 bp, mouse
gcctcccttagcaacgaatc

SEQ ID NO: 844160 - DNA, 20 bp, mouse
gaggagcaaaggaaccgggg

SEQ ID NO: 844161 - DNA, 20 bp, mouse
gttagcaacgaatcaggctg

SEQ ID NO: 844162 - DNA, 20 bp, mouse
ggctaggagcaaaggaaccg

SEQ ID NO: 844163 - DNA, 20 bp, mouse
ggagcttggttcatgtggaa

SEQ ID NO: 844164 - DNA, 20 bp, mouse
gctgcggttgctaggagcaa

SEQ ID NO: 844165 - DNA, 20 bp, mouse
gaaagtggaggaacccgcgg

SEQ ID NO: 844166 - DNA, 20 bp, mouse
gcgagggagtccttgaatca

SEQ ID NO: 844167 - DNA, 20 bp, mouse
ggaaccacgccctaagccga

SEQ ID NO: 844168 - DNA, 20 bp, mouse
gaggccgccatattgactgt

SEQ ID NO: 844169 - DNA, 20 bp, mouse
gactccctcggcttagggcg

SEQ ID NO: 844170 - DNA, 20 bp, mouse
gagtccttgaatcagggttc

SEQ ID NO: 844171 - DNA, 20 bp, mouse
gggcacggtcctaaacgtta

SEQ ID NO: 844172 - DNA, 20 bp, mouse
gctccctgaaccctgattca

SEQ ID NO: 844173 - DNA, 20 bp, mouse
gtcaaggactccctcggctt

SEQ ID NO: 844174 - DNA, 20 bp, mouse
gaccgtgcccatactaaaca

SEQ ID NO: 844175 - DNA, 20 bp, mouse
ggcagcttcagtgcggggcg

SEQ ID NO: 844176 - DNA, 20 bp, mouse
gctcccgccagcaccgccgc

SEQ ID NO: 844177 - DNA, 20 bp, mouse
gccaaggcccgggacggttc

SEQ ID NO: 844178 - DNA, 20 bp, mouse
gccccccggcggccattacc

SEQ ID NO: 844179 - DNA, 20 bp, mouse
ggagtgaggcgagacgcgaa

SEQ ID NO: 844180 - DNA, 20 bp, mouse
gcgcgctcttagcgtggggt

SEQ ID NO: 844181 - DNA, 20 bp, mouse
ggggagcgggtcacgtgact

SEQ ID NO: 844182 - DNA, 20 bp, mouse
ggcggagcgtggccccccgg

SEQ ID NO: 844183 - DNA, 20 bp, mouse
gtaagagcgcgcaggggggg

SEQ ID NO: 844184 - DNA, 20 bp, mouse
gcctgacccaaggcccggga

SEQ ID NO: 844185 - DNA, 20 bp, mouse
gccgcgggtcacctgaccca

SEQ ID NO: 844186 - DNA, 20 bp, mouse
ggtggtgtacacgtcagctc

SEQ ID NO: 844187 - DNA, 20 bp, mouse
ggcttcccaaggtctcgtcg

SEQ ID NO: 844188 - DNA, 20 bp, mouse
ggtcacaagacagcttccca

SEQ ID NO: 844189 - DNA, 20 bp, mouse
gcgctaggcctgtgctagac

SEQ ID NO: 844190 - DNA, 20 bp, mouse
gcccggggcgtgtctcccca

SEQ ID NO: 844191 - DNA, 20 bp, mouse
gcaaacttcagacctttctg

SEQ ID NO: 844192 - DNA, 20 bp, mouse
gagcagaaatgcggccgaag

SEQ ID NO: 844193 - DNA, 20 bp, mouse
gagaaccgaggccaggcccg

SEQ ID NO: 844194 - DNA, 20 bp, mouse
gcaggttgcctgtctagcac

SEQ ID NO: 844195 - DNA, 20 bp, mouse
gaccttggggagacacgccc

SEQ ID NO: 844196 - DNA, 20 bp, mouse
gcgcacagggggtggaccga

SEQ ID NO: 844197 - DNA, 20 bp, mouse
gcggggaggccggacggaag

SEQ ID NO: 844198 - DNA, 20 bp, mouse
gagggcgtgcggcgtgtgtg

SEQ ID NO: 844199 - DNA, 20 bp, mouse
gccggagcgcggagcccgta

SEQ ID NO: 844200 - DNA, 20 bp, mouse
ggggcggcgcgctccccttc

SEQ ID NO: 844201 - DNA, 20 bp, mouse
gagcgcggagcccgtagggg

SEQ ID NO: 844202 - DNA, 20 bp, mouse
gggagggcggccagcggctc

SEQ ID NO: 844203 - DNA, 20 bp, mouse
gcacccgcctccccccgcgg

SEQ ID NO: 844204 - DNA, 20 bp, mouse
ggagcccgtaggggcgggag

SEQ ID NO: 844205 - DNA, 20 bp, mouse
ggcggggggaggcgggtgag

SEQ ID NO: 844206 - DNA, 20 bp, mouse
gcccggcacgcggcacagga

SEQ ID NO: 844207 - DNA, 20 bp, mouse
gccggcggggcgggccagta

SEQ ID NO: 844208 - DNA, 20 bp, mouse
gggtcccagtgccggcgggg

SEQ ID NO: 844209 - DNA, 20 bp, mouse
gagccagcgcagcttcgcta

SEQ ID NO: 844210 - DNA, 20 bp, mouse
gggcacaggaaggaacgcag

SEQ ID NO: 844211 - DNA, 20 bp, mouse
gccggactccacctcccagg

SEQ ID NO: 844212 - DNA, 20 bp, mouse
gcggagagccagccccctac

SEQ ID NO: 844213 - DNA, 20 bp, mouse
ggctctccgcgtagcctcct

SEQ ID NO: 844214 - DNA, 20 bp, mouse
gcgaagctgcgctggctgga

SEQ ID NO: 844215 - DNA, 20 bp, mouse
gctccgcgtagcctcctggg

SEQ ID NO: 844216 - DNA, 20 bp, mouse
gtgcccttcacgcggactca

SEQ ID NO: 844217 - DNA, 20 bp, mouse
ggagtccagagaccctgctg

SEQ ID NO: 844218 - DNA, 20 bp, mouse
ggcgtcgcgaatagcagaga

SEQ ID NO: 844219 - DNA, 20 bp, mouse
gtaacggcgacttgtctccc

SEQ ID NO: 844220 - DNA, 20 bp, mouse
ggcacgttcgccttaagagg

SEQ ID NO: 844221 - DNA, 20 bp, mouse
gctccctgagtccgcgtgaa

SEQ ID NO: 844222 - DNA, 20 bp, mouse
ggactggcaggcctgcgggg

SEQ ID NO: 844223 - DNA, 20 bp, mouse
gaaaagctccggaagcgtcc

SEQ ID NO: 844224 - DNA, 20 bp, mouse
gcgcgaatagcagagaaggg

SEQ ID NO: 844225 - DNA, 20 bp, mouse
gcctgcgcactggcaatgtc

SEQ ID NO: 844226 - DNA, 20 bp, mouse
gtaggggacccagaagataa

SEQ ID NO: 844227 - DNA, 20 bp, mouse
gtgggaattagtggagataa

SEQ ID NO: 844228 - DNA, 20 bp, mouse
gcactaattcccaatagccc

SEQ ID NO: 844229 - DNA, 20 bp, mouse
gcttaaaggggctgagagcc

SEQ ID NO: 844230 - DNA, 20 bp, mouse
gagagagaaaggaatgagct

SEQ ID NO: 844231 - DNA, 20 bp, mouse
ggaaggcctgcgatcggtga

SEQ ID NO: 844232 - DNA, 20 bp, mouse
gggctgagagccagggctat

SEQ ID NO: 844233 - DNA, 20 bp, mouse
ggataaaggaggggaatggc

SEQ ID NO: 844234 - DNA, 20 bp, mouse
ggtagattcgaaatccttaa

SEQ ID NO: 844235 - DNA, 20 bp, mouse
ggagagagggcactttcatt

SEQ ID NO: 844236 - DNA, 20 bp, mouse
gggaggagctacatggagaa

SEQ ID NO: 844237 - DNA, 20 bp, mouse
gggcggggccagcaggaaat

SEQ ID NO: 844238 - DNA, 20 bp, mouse
gagggggcgcggcctatcgg

SEQ ID NO: 844239 - DNA, 20 bp, mouse
gtgcgcctgcgcgccaggga

SEQ ID NO: 844240 - DNA, 20 bp, mouse
gagactgtgtggtacgtcac

SEQ ID NO: 844241 - DNA, 20 bp, mouse
ggaaaggaccggaaaaaagt

SEQ ID NO: 844242 - DNA, 20 bp, mouse
ggaaatgggtcgaacgtagc

SEQ ID NO: 844243 - DNA, 20 bp, mouse
gggtcgaacgtagccgggaa

SEQ ID NO: 844244 - DNA, 20 bp, mouse
gggaagggggcgcggcctat

SEQ ID NO: 844245 - DNA, 20 bp, mouse
ggaccggaaaaaagtgggcg

SEQ ID NO: 844246 - DNA, 20 bp, mouse
gtcgctgtgagggacaatac

SEQ ID NO: 844247 - DNA, 20 bp, mouse
ggcgctacgagtcgctgtga

SEQ ID NO: 844248 - DNA, 20 bp, mouse
gcagagatgtcccctgatca

SEQ ID NO: 844249 - DNA, 20 bp, mouse
gttaagccgtgaagagatgt

SEQ ID NO: 844250 - DNA, 20 bp, mouse
ggtcctgaagctatctcggg

SEQ ID NO: 844251 - DNA, 20 bp, mouse
gatctcttcacggcttaaat

SEQ ID NO: 844252 - DNA, 20 bp, mouse
gagcgcgctgcgtttctatg

SEQ ID NO: 844253 - DNA, 20 bp, mouse
gtgctgcccgtgctcggcgc

SEQ ID NO: 844254 - DNA, 20 bp, mouse
gtgttcgaaactatctcggt

SEQ ID NO: 844255 - DNA, 20 bp, mouse
gctccacccgagatagcttc

SEQ ID NO: 844256 - DNA, 20 bp, mouse
ggctggtgctagtattgaaa

SEQ ID NO: 844257 - DNA, 20 bp, mouse
gtcttaggcactcttatcat

SEQ ID NO: 844258 - DNA, 20 bp, mouse
gtggagacgtggatgttaca

SEQ ID NO: 844259 - DNA, 20 bp, mouse
gaggcagttagtctcttctt

SEQ ID NO: 844260 - DNA, 20 bp, mouse
gacaaagactctagtgtttc

SEQ ID NO: 844261 - DNA, 20 bp, mouse
ggggtgatgaaatacgttct

SEQ ID NO: 844262 - DNA, 20 bp, mouse
gaaggcatctacatacactg

SEQ ID NO: 844263 - DNA, 20 bp, mouse
gctagagtctttgtaagata

SEQ ID NO: 844264 - DNA, 20 bp, mouse
ggtctttgtaagatagggaa

SEQ ID NO: 844265 - DNA, 20 bp, mouse
gttgtcaggcctttggaatc

SEQ ID NO: 844266 - DNA, 20 bp, mouse
ggagaagaggcgaaagtcga

SEQ ID NO: 844267 - DNA, 20 bp, mouse
ggggccagcagtcagatcgc

SEQ ID NO: 844268 - DNA, 20 bp, mouse
gagccgaagcggacagaagc

SEQ ID NO: 844269 - DNA, 20 bp, mouse
gggagccgctcagacacggg

SEQ ID NO: 844270 - DNA, 20 bp, mouse
gaagaggcgaaagtcgacgg

SEQ ID NO: 844271 - DNA, 20 bp, mouse
ggatggagcgagtgactgat

SEQ ID NO: 844272 - DNA, 20 bp, mouse
gcgagtgactgatgggtcga

SEQ ID NO: 844273 - DNA, 20 bp, mouse
gcgcaggagccgctcagaca

SEQ ID NO: 844274 - DNA, 20 bp, mouse
gcaggctggacgcccagagg

SEQ ID NO: 844275 - DNA, 20 bp, mouse
gaagcaggctggacgcccag

SEQ ID NO: 844276 - DNA, 20 bp, mouse
ggcgccacgcggagatttat

SEQ ID NO: 844277 - DNA, 20 bp, mouse
gggaagtgtagtcgcatctg

SEQ ID NO: 844278 - DNA, 20 bp, mouse
gtggctccaacgctttttgc

SEQ ID NO: 844279 - DNA, 20 bp, mouse
gtgaaagctctaacagaatg

SEQ ID NO: 844280 - DNA, 20 bp, mouse
ggattgaaggcgatgtaaga

SEQ ID NO: 844281 - DNA, 20 bp, mouse
ggtctcctccaacctctatc

SEQ ID NO: 844282 - DNA, 20 bp, mouse
gctgctggagctcttcggat

SEQ ID NO: 844283 - DNA, 20 bp, mouse
ggacgagggagatacaaatg

SEQ ID NO: 844284 - DNA, 20 bp, mouse
ggcgtggcgcgacgcaccct

SEQ ID NO: 844285 - DNA, 20 bp, mouse
gaataaagatggagggtgat

SEQ ID NO: 844286 - DNA, 20 bp, mouse
gaggggccgtcgcccaaggg

SEQ ID NO: 844287 - DNA, 20 bp, mouse
ggggaggggccgtcgcccaa

SEQ ID NO: 844288 - DNA, 20 bp, mouse
gggtccgacgccctgattgg

SEQ ID NO: 844289 - DNA, 20 bp, mouse
gggccgtcgcgcaagaggcg

SEQ ID NO: 844290 - DNA, 20 bp, mouse
gctaacgggccgggcaaacg

SEQ ID NO: 844291 - DNA, 20 bp, mouse
gcgcgacggcccctgggcgg

SEQ ID NO: 844292 - DNA, 20 bp, mouse
gttgcgcgacggcccctggg

SEQ ID NO: 844293 - DNA, 20 bp, mouse
gaggcgcggcgcgcagctaa

SEQ ID NO: 844294 - DNA, 20 bp, mouse
gggccgggcaaacgcgggag

SEQ ID NO: 844295 - DNA, 20 bp, mouse
ggccctggtgcgccccctgg

SEQ ID NO: 844296 - DNA, 20 bp, mouse
ggaaggcgagccgaggtgaa

SEQ ID NO: 844297 - DNA, 20 bp, mouse
ggcggggaagtccactaggc

SEQ ID NO: 844298 - DNA, 20 bp, mouse
gaagggcggggaagtccact

SEQ ID NO: 844299 - DNA, 20 bp, mouse
gaggtgaaaggcctgttcca

SEQ ID NO: 844300 - DNA, 20 bp, mouse
ggacacctgggcacgaacag

SEQ ID NO: 844301 - DNA, 20 bp, mouse
gagcgtagctaacccgggga

SEQ ID NO: 844302 - DNA, 20 bp, mouse
gaaacagcgtagctaacccg

SEQ ID NO: 844303 - DNA, 20 bp, mouse
gacgctgtttagggatgggc

SEQ ID NO: 844304 - DNA, 20 bp, mouse
gttcccagctccagccgcgg

SEQ ID NO: 844305 - DNA, 20 bp, mouse
ggaaaggcctgttccaaggc

SEQ ID NO: 844306 - DNA, 20 bp, mouse
gtggggttggcactacatta

SEQ ID NO: 844307 - DNA, 20 bp, mouse
gtaatgtgctgctgggatgg

SEQ ID NO: 844308 - DNA, 20 bp, mouse
gtaataatgtgctgctggga

SEQ ID NO: 844309 - DNA, 20 bp, mouse
gttacaatcaagctctttca

SEQ ID NO: 844310 - DNA, 20 bp, mouse
gctcccttttcctaggaaag

SEQ ID NO: 844311 - DNA, 20 bp, mouse
gtaggaaagtggttttcagg

SEQ ID NO: 844312 - DNA, 20 bp, mouse
ggtggaggggtaaataaaca

SEQ ID NO: 844313 - DNA, 20 bp, mouse
ggatctagaagagttgcaac

SEQ ID NO: 844314 - DNA, 20 bp, mouse
gcggcataataatgtgctgc

SEQ ID NO: 844315 - DNA, 20 bp, mouse
gaaagaggttgcaatgcaaa

SEQ ID NO: 844316 - DNA, 20 bp, mouse
gcgcctgcatccaggccccg

SEQ ID NO: 844317 - DNA, 20 bp, mouse
gggctggcactgtaatcagt

SEQ ID NO: 844318 - DNA, 20 bp, mouse
gagggcggggtctggtgttc

SEQ ID NO: 844319 - DNA, 20 bp, mouse
gaaagccagcgcctgcatcc

SEQ ID NO: 844320 - DNA, 20 bp, mouse
gcttggaggttggagcatgg

SEQ ID NO: 844321 - DNA, 20 bp, mouse
gccaacctccaagccgccaa

SEQ ID NO: 844322 - DNA, 20 bp, mouse
ggttctgggtgggccgaagg

SEQ ID NO: 844323 - DNA, 20 bp, mouse
gaggagtgtagatgggatga

SEQ ID NO: 844324 - DNA, 20 bp, mouse
ggcgactttaggttccgagt

SEQ ID NO: 844325 - DNA, 20 bp, mouse
gccaaaggaaaacccagatc

SEQ ID NO: 844326 - DNA, 20 bp, mouse
gggcaccgagcgggacccta

SEQ ID NO: 844327 - DNA, 20 bp, mouse
gctgccagccaggacccgct

SEQ ID NO: 844328 - DNA, 20 bp, mouse
gcagccgagcgggtcctggc

SEQ ID NO: 844329 - DNA, 20 bp, mouse
gccagtgcccggtacggtcc

SEQ ID NO: 844330 - DNA, 20 bp, mouse
gggcagcgggagcatagcag

SEQ ID NO: 844331 - DNA, 20 bp, mouse
ggccgggaggcgcggaaccg

SEQ ID NO: 844332 - DNA, 20 bp, mouse
ggggtcagccgagcgggtcc

SEQ ID NO: 844333 - DNA, 20 bp, mouse
gccagtggggtcagccgagc

SEQ ID NO: 844334 - DNA, 20 bp, mouse
gagcaagaacggcttccagt

SEQ ID NO: 844335 - DNA, 20 bp, mouse
gtggcggagcgacgcagccc

SEQ ID NO: 844336 - DNA, 20 bp, mouse
ggggtggtttatactcaagt

SEQ ID NO: 844337 - DNA, 20 bp, mouse
gttccaggagggagtctccg

SEQ ID NO: 844338 - DNA, 20 bp, mouse
gagccccggagactccctcc

SEQ ID NO: 844339 - DNA, 20 bp, mouse
gaattcccatggcccctaaa

SEQ ID NO: 844340 - DNA, 20 bp, mouse
gccatggcccctaaagggaa

SEQ ID NO: 844341 - DNA, 20 bp, mouse
gggagaagaccaaattccca

SEQ ID NO: 844342 - DNA, 20 bp, mouse
gtgtcctgggctgtgagccc

SEQ ID NO: 844343 - DNA, 20 bp, mouse
gtggcccctaaagggaatgg

SEQ ID NO: 844344 - DNA, 20 bp, mouse
gaatgactctgtagggaagc

SEQ ID NO: 844345 - DNA, 20 bp, mouse
gcaagctgaatgactctgta

SEQ ID NO: 844346 - DNA, 20 bp, mouse
gaaagagtctggggactgca

SEQ ID NO: 844347 - DNA, 20 bp, mouse
ggtccctaaggagagtgggg

SEQ ID NO: 844348 - DNA, 20 bp, mouse
gagccggaggatgggaggac

SEQ ID NO: 844349 - DNA, 20 bp, mouse
gggccgacagagggagccgg

SEQ ID NO: 844350 - DNA, 20 bp, mouse
gtaccccaggcgccagacgc

SEQ ID NO: 844351 - DNA, 20 bp, mouse
gacggccgcctgcatacccc

SEQ ID NO: 844352 - DNA, 20 bp, mouse
ggggactgcagggctgaaag

SEQ ID NO: 844353 - DNA, 20 bp, mouse
ggaggtccctaaggagagtg

SEQ ID NO: 844354 - DNA, 20 bp, mouse
gacagagggagccggaggat

SEQ ID NO: 844355 - DNA, 20 bp, mouse
gccctccctcggccgacaga

SEQ ID NO: 844356 - DNA, 20 bp, mouse
gagcacgcatgcgcagactg

SEQ ID NO: 844357 - DNA, 20 bp, mouse
gaccccgcgcctgcggacgt

SEQ ID NO: 844358 - DNA, 20 bp, mouse
ggggccaccgggactgtgag

SEQ ID NO: 844359 - DNA, 20 bp, mouse
gtcgtcggagtagacgacgg

SEQ ID NO: 844360 - DNA, 20 bp, mouse
gagggcaagctctcgctcgt

SEQ ID NO: 844361 - DNA, 20 bp, mouse
gaagccaagcgtctgcccaa

SEQ ID NO: 844362 - DNA, 20 bp, mouse
gaaagcccatgtaatccgac

SEQ ID NO: 844363 - DNA, 20 bp, mouse
gcgctcgtcggagtagacga

SEQ ID NO: 844364 - DNA, 20 bp, mouse
ggcggagcgcgaggcatcct

SEQ ID NO: 844365 - DNA, 20 bp, mouse
gtagctagctgccttcacca

SEQ ID NO: 844366 - DNA, 20 bp, mouse
gcgcccccaaggcgtccaac

SEQ ID NO: 844367 - DNA, 20 bp, mouse
gtcaacccgttggacgcctt

SEQ ID NO: 844368 - DNA, 20 bp, mouse
ggggcgtcctgtcaacccgt

SEQ ID NO: 844369 - DNA, 20 bp, mouse
gccacagggagcgccatctc

SEQ ID NO: 844370 - DNA, 20 bp, mouse
ggggcactgtgatctctcag

SEQ ID NO: 844371 - DNA, 20 bp, mouse
ggacccgagaaaaacggcgg

SEQ ID NO: 844372 - DNA, 20 bp, mouse
gccccccagcgttaggaggc

SEQ ID NO: 844373 - DNA, 20 bp, mouse
gttctagaacgtcatcgact

SEQ ID NO: 844374 - DNA, 20 bp, mouse
gccctgtgggcgtgtcgccg

SEQ ID NO: 844375 - DNA, 20 bp, mouse
gaattcatgaaagtagccta

SEQ ID NO: 844376 - DNA, 20 bp, mouse
gtgccctgggagagcaggat

SEQ ID NO: 844377 - DNA, 20 bp, mouse
ggggtggagcgccaggaggc

SEQ ID NO: 844378 - DNA, 20 bp, mouse
ggcaaggaggcggtagccca

SEQ ID NO: 844379 - DNA, 20 bp, mouse
gcacactgagtcgcgctcat

SEQ ID NO: 844380 - DNA, 20 bp, mouse
gcagagggtggagcgccagg

SEQ ID NO: 844381 - DNA, 20 bp, mouse
gtcatgtggcggttccagga

SEQ ID NO: 844382 - DNA, 20 bp, mouse
gaaggcaagacgcgcgagat

SEQ ID NO: 844383 - DNA, 20 bp, mouse
gtacccgcggcgctttttat

SEQ ID NO: 844384 - DNA, 20 bp, mouse
gagggcaagtgctcatgtgg

SEQ ID NO: 844385 - DNA, 20 bp, mouse
ggcgtggggaatgggcttac

SEQ ID NO: 844386 - DNA, 20 bp, mouse
gagggacatctcttccccta

SEQ ID NO: 844387 - DNA, 20 bp, mouse
gtgagaaacccagaaataga

SEQ ID NO: 844388 - DNA, 20 bp, mouse
gcactgtccccaaatccaga

SEQ ID NO: 844389 - DNA, 20 bp, mouse
gggtgacaattgtgatgcag

SEQ ID NO: 844390 - DNA, 20 bp, mouse
gggggaagagatgtccctct

SEQ ID NO: 844391 - DNA, 20 bp, mouse
gctaacagcctgtgtactat

SEQ ID NO: 844392 - DNA, 20 bp, mouse
gatgtccctctagggttcat

SEQ ID NO: 844393 - DNA, 20 bp, mouse
gctgctcccatgaaccctag

SEQ ID NO: 844394 - DNA, 20 bp, mouse
gggttctaacgtgttgtcaa

SEQ ID NO: 844395 - DNA, 20 bp, mouse
gcacagagatgttcaccctc

SEQ ID NO: 844396 - DNA, 20 bp, mouse
gggcccccagccccggaatc

SEQ ID NO: 844397 - DNA, 20 bp, mouse
gggggcccatacgtggagag

SEQ ID NO: 844398 - DNA, 20 bp, mouse
gtgctggaggcctgattccg

SEQ ID NO: 844399 - DNA, 20 bp, mouse
gcccatacgtggagagggga

SEQ ID NO: 844400 - DNA, 20 bp, mouse
gagaaggggtttttctgcct

SEQ ID NO: 844401 - DNA, 20 bp, mouse
gctgaaagggattctaccag

SEQ ID NO: 844402 - DNA, 20 bp, mouse
gatagtaccgctgtccccct

SEQ ID NO: 844403 - DNA, 20 bp, mouse
gcagaaaaaccccttctgaa

SEQ ID NO: 844404 - DNA, 20 bp, mouse
gcggtactattcatccctgc

SEQ ID NO: 844405 - DNA, 20 bp, mouse
gggggctgggggcccatacg

SEQ ID NO: 844406 - DNA, 20 bp, mouse
gaaagccgggaactcacgtg

SEQ ID NO: 844407 - DNA, 20 bp, mouse
gggaaagggagcatcacccg

SEQ ID NO: 844408 - DNA, 20 bp, mouse
ggcggggcgtcctgacgcgg

SEQ ID NO: 844409 - DNA, 20 bp, mouse
gccgcgcgccacccccgcgt

SEQ ID NO: 844410 - DNA, 20 bp, mouse
gggtgatgctccctttccga

SEQ ID NO: 844411 - DNA, 20 bp, mouse
gcgggccagtgggactggaa

SEQ ID NO: 844412 - DNA, 20 bp, mouse
gcggggcgagacgaggaggc

SEQ ID NO: 844413 - DNA, 20 bp, mouse
gcgcgcacgcccaagaccca

SEQ ID NO: 844414 - DNA, 20 bp, mouse
gaagacccaggggccggtct

SEQ ID NO: 844415 - DNA, 20 bp, mouse
ggcggggcgggctgtgagac

SEQ ID NO: 844416 - DNA, 20 bp, mouse
gacagaggctagggtacaga

SEQ ID NO: 844417 - DNA, 20 bp, mouse
gctcctgaaggcaaggtcat

SEQ ID NO: 844418 - DNA, 20 bp, mouse
gcagaccggaacagaggcta

SEQ ID NO: 844419 - DNA, 20 bp, mouse
ggtggggcagtgacacagac

SEQ ID NO: 844420 - DNA, 20 bp, mouse
gcaagcgcaaggagcaacag

SEQ ID NO: 844421 - DNA, 20 bp, mouse
gaaccacaaaggcacacaac

SEQ ID NO: 844422 - DNA, 20 bp, mouse
gtgtaccctagcctctgttc

SEQ ID NO: 844423 - DNA, 20 bp, mouse
ggcaaggtcatcggaaagta

SEQ ID NO: 844424 - DNA, 20 bp, mouse
gttatgacgaacgtcacagg

SEQ ID NO: 844425 - DNA, 20 bp, mouse
gaggaactaaccagaactct

SEQ ID NO: 844426 - DNA, 20 bp, mouse
gacagcccctgccttcccgg

SEQ ID NO: 844427 - DNA, 20 bp, mouse
gccgcaacggcgactgttgg

SEQ ID NO: 844428 - DNA, 20 bp, mouse
gcggccgcaacggcgactgt

SEQ ID NO: 844429 - DNA, 20 bp, mouse
ggcggcggccgcggccgcaa

SEQ ID NO: 844430 - DNA, 20 bp, mouse
gaccccctcttcatgcagag

SEQ ID NO: 844431 - DNA, 20 bp, mouse
gccgccgggcgcgcgctcga

SEQ ID NO: 844432 - DNA, 20 bp, mouse
gtcccgggagagccgccctg

SEQ ID NO: 844433 - DNA, 20 bp, mouse
gttccccagggcggctctcc

SEQ ID NO: 844434 - DNA, 20 bp, mouse
gctgtccgcccgcgccaaga

SEQ ID NO: 844435 - DNA, 20 bp, mouse
gcgcgcgctcgatgggctgc

SEQ ID NO: 844436 - DNA, 20 bp, mouse
gccggcgccccgctccagca

SEQ ID NO: 844437 - DNA, 20 bp, mouse
ggcgctccgctgcctcacag

SEQ ID NO: 844438 - DNA, 20 bp, mouse
gctcacccgggcaaatacgt

SEQ ID NO: 844439 - DNA, 20 bp, mouse
gcccgccagccctgctggag

SEQ ID NO: 844440 - DNA, 20 bp, mouse
gtaggggtgctcgcgggaac

SEQ ID NO: 844441 - DNA, 20 bp, mouse
gcggggctccggctgagggt

SEQ ID NO: 844442 - DNA, 20 bp, mouse
gagcggagcgaacgagacga

SEQ ID NO: 844443 - DNA, 20 bp, mouse
gtgagggtaggggtgctcgc

SEQ ID NO: 844444 - DNA, 20 bp, mouse
ggccgcggggctccggctga

SEQ ID NO: 844445 - DNA, 20 bp, mouse
gtgcccgggtgagaatcccg

SEQ ID NO: 844446 - DNA, 20 bp, mouse
ggctttgtctcaattgataa

SEQ ID NO: 844447 - DNA, 20 bp, mouse
gctatgcattcactccgctg

SEQ ID NO: 844448 - DNA, 20 bp, mouse
gcctctgctcaccaaactta

SEQ ID NO: 844449 - DNA, 20 bp, mouse
gagcagaggtgtaattagta

SEQ ID NO: 844450 - DNA, 20 bp, mouse
gctgatggagatttaaccta

SEQ ID NO: 844451 - DNA, 20 bp, mouse
ggtcacatcttctttaatcc

SEQ ID NO: 844452 - DNA, 20 bp, mouse
gggcctaagaagcaaggaaa

SEQ ID NO: 844453 - DNA, 20 bp, mouse
gaccagtaagaggacattta

SEQ ID NO: 844454 - DNA, 20 bp, mouse
ggtcctcttactggtcacat

SEQ ID NO: 844455 - DNA, 20 bp, mouse
gaacctagggaagagccaag

SEQ ID NO: 844456 - DNA, 20 bp, mouse
gagggcggccctctccggaa

SEQ ID NO: 844457 - DNA, 20 bp, mouse
gacatcagggcggccctctc

SEQ ID NO: 844458 - DNA, 20 bp, mouse
ggccctgatgtccctcccta

SEQ ID NO: 844459 - DNA, 20 bp, mouse
gtctcgaaacgtcacggcga

SEQ ID NO: 844460 - DNA, 20 bp, mouse
gacagaaaggcggagttaca

SEQ ID NO: 844461 - DNA, 20 bp, mouse
gggcctgagcatgcgtcgga

SEQ ID NO: 844462 - DNA, 20 bp, mouse
gtcggaaggacagtttgagc

SEQ ID NO: 844463 - DNA, 20 bp, mouse
gcccgtagggagggacatca

SEQ ID NO: 844464 - DNA, 20 bp, mouse
gggaagggtgagcgccgaac

SEQ ID NO: 844465 - DNA, 20 bp, mouse
ggcgctcacccttccggaga

SEQ ID NO: 844466 - DNA, 20 bp, mouse
gaccccctgcagtggccgtc

SEQ ID NO: 844467 - DNA, 20 bp, mouse
gggaggggaagacaatgcta

SEQ ID NO: 844468 - DNA, 20 bp, mouse
gagcgctgtgggccactagg

SEQ ID NO: 844469 - DNA, 20 bp, mouse
ggggccgggccgggcgctga

SEQ ID NO: 844470 - DNA, 20 bp, mouse
gggaacactgcgagctgggt

SEQ ID NO: 844471 - DNA, 20 bp, mouse
gccctctccctgtccacctc

SEQ ID NO: 844472 - DNA, 20 bp, mouse
gactgcagggggtcatgcga

SEQ ID NO: 844473 - DNA, 20 bp, mouse
gcccttgcccagcccccctc

SEQ ID NO: 844474 - DNA, 20 bp, mouse
gcggaccactccaaagagga

SEQ ID NO: 844475 - DNA, 20 bp, mouse
gcaacagcctgaggtggaca

SEQ ID NO: 844476 - DNA, 20 bp, mouse
gaaggggcctctttgagcga

SEQ ID NO: 844477 - DNA, 20 bp, mouse
ggcgccacgcaaaggctcaa

SEQ ID NO: 844478 - DNA, 20 bp, mouse
ggtgaaatcgcagctagaaa

SEQ ID NO: 844479 - DNA, 20 bp, mouse
ggcagctagaaaaggaccac

SEQ ID NO: 844480 - DNA, 20 bp, mouse
ggagctgcctcattagtact

SEQ ID NO: 844481 - DNA, 20 bp, mouse
gtcaaagaggccccttcctg

SEQ ID NO: 844482 - DNA, 20 bp, mouse
gtctaaccggaaaatatatt

SEQ ID NO: 844483 - DNA, 20 bp, mouse
gtctttgagcgatggcttag

SEQ ID NO: 844484 - DNA, 20 bp, mouse
ggagcgatggcttaggggtg

SEQ ID NO: 844485 - DNA, 20 bp, mouse
gagaagcaatggtttagagg

SEQ ID NO: 844486 - DNA, 20 bp, mouse
ggggaagaccagagcacttc

SEQ ID NO: 844487 - DNA, 20 bp, mouse
gagcctgcaaagtgtgagtc

SEQ ID NO: 844488 - DNA, 20 bp, mouse
ggggaactgcggcgacaggg

SEQ ID NO: 844489 - DNA, 20 bp, mouse
gttccggcagggctccgcag

SEQ ID NO: 844490 - DNA, 20 bp, mouse
gtgcccgcgtgctctcaagc

SEQ ID NO: 844491 - DNA, 20 bp, mouse
gcgcgggcagggccggggaa

SEQ ID NO: 844492 - DNA, 20 bp, mouse
gccgcaggaaagtgtttgtg

SEQ ID NO: 844493 - DNA, 20 bp, mouse
ggcaggcgcagtgggaactg

SEQ ID NO: 844494 - DNA, 20 bp, mouse
gttgcccgcccagcaggcgc

SEQ ID NO: 844495 - DNA, 20 bp, mouse
gctgctggaaagcgctggag

SEQ ID NO: 844496 - DNA, 20 bp, mouse
gtcgagcccagggttggaga

SEQ ID NO: 844497 - DNA, 20 bp, mouse
gccagcgtcgagcccagggt

SEQ ID NO: 844498 - DNA, 20 bp, mouse
gcgagtccagcgtcgagccc

SEQ ID NO: 844499 - DNA, 20 bp, mouse
gcaaggcagggaggatcggg

SEQ ID NO: 844500 - DNA, 20 bp, mouse
ggggccgaggatcagcaaca

SEQ ID NO: 844501 - DNA, 20 bp, mouse
gagggaagcccctgtcaagg

SEQ ID NO: 844502 - DNA, 20 bp, mouse
gtggactcggtgtcacatta

SEQ ID NO: 844503 - DNA, 20 bp, mouse
gtcaaggaggtggagcgaga

SEQ ID NO: 844504 - DNA, 20 bp, mouse
gcgtctcgcgccagagagaa

SEQ ID NO: 844505 - DNA, 20 bp, mouse
gaagaggtcgctggtagcgc

SEQ ID NO: 844506 - DNA, 20 bp, mouse
ggggcggggcggctagacga

SEQ ID NO: 844507 - DNA, 20 bp, mouse
ggggcggctagacgatggga

SEQ ID NO: 844508 - DNA, 20 bp, mouse
gaggaactaggtaggcgagg

SEQ ID NO: 844509 - DNA, 20 bp, mouse
gaaaggactagaaaggggat

SEQ ID NO: 844510 - DNA, 20 bp, mouse
ggtcctgggtccctaaggaa

SEQ ID NO: 844511 - DNA, 20 bp, mouse
gctaaggaaaggactagaaa

SEQ ID NO: 844512 - DNA, 20 bp, mouse
gtgggagggtcgcaacgacc

SEQ ID NO: 844513 - DNA, 20 bp, mouse
ggggacccaggacctgagaa

SEQ ID NO: 844514 - DNA, 20 bp, mouse
ggccgcccacacacgctcta

SEQ ID NO: 844515 - DNA, 20 bp, mouse
gggatgggctagaataagca

SEQ ID NO: 844516 - DNA, 20 bp, mouse
gggagcgaagtctaggtctc

SEQ ID NO: 844517 - DNA, 20 bp, mouse
gtcaagcggcctgaatcgga

SEQ ID NO: 844518 - DNA, 20 bp, mouse
gcggaagcaggcccaagacg

SEQ ID NO: 844519 - DNA, 20 bp, mouse
gggcctgaatcggagggttc

SEQ ID NO: 844520 - DNA, 20 bp, mouse
ggattcaggccgcttgagag

SEQ ID NO: 844521 - DNA, 20 bp, mouse
ggcggcctggagcgaagtct

SEQ ID NO: 844522 - DNA, 20 bp, mouse
gaggccgcacgttggcatct

SEQ ID NO: 844523 - DNA, 20 bp, mouse
gtcccagaaccctccgattc

SEQ ID NO: 844524 - DNA, 20 bp, mouse
ggttcccagatgccaacgtg

SEQ ID NO: 844525 - DNA, 20 bp, mouse
gttcgctccaggccgcacgt

SEQ ID NO: 844526 - DNA, 20 bp, mouse
ggcagtgcggaccaactggc

SEQ ID NO: 844527 - DNA, 20 bp, mouse
ggccctcaccacactaatct

SEQ ID NO: 844528 - DNA, 20 bp, mouse
gaccggcaagtcccacccac

SEQ ID NO: 844529 - DNA, 20 bp, mouse
ggattggtcgatggaaaagc

SEQ ID NO: 844530 - DNA, 20 bp, mouse
gggtccgcactgccggtggg

SEQ ID NO: 844531 - DNA, 20 bp, mouse
gaccggcagtgcggaccaac

SEQ ID NO: 844532 - DNA, 20 bp, mouse
ggaggcttgcaaagtattgt

SEQ ID NO: 844533 - DNA, 20 bp, mouse
gggtgctgcgctgtcaggga

SEQ ID NO: 844534 - DNA, 20 bp, mouse
gtccgagattagtgtggtga

SEQ ID NO: 844535 - DNA, 20 bp, mouse
ggcgctccaggattggtcga

SEQ ID NO: 844536 - DNA, 20 bp, mouse
gccgctcgccggtgcctgag

SEQ ID NO: 844537 - DNA, 20 bp, mouse
gggcgagggtcggggaaacg

SEQ ID NO: 844538 - DNA, 20 bp, mouse
ggggtgctgggccgtggcga

SEQ ID NO: 844539 - DNA, 20 bp, mouse
gggtgcctgaggggactcct

SEQ ID NO: 844540 - DNA, 20 bp, mouse
gggagggtgagtggcgagta

SEQ ID NO: 844541 - DNA, 20 bp, mouse
gggaagacctgaggcgtcca

SEQ ID NO: 844542 - DNA, 20 bp, mouse
gcgggcgcgggcacgtgggt

SEQ ID NO: 844543 - DNA, 20 bp, mouse
gggccccagcagctgcgtca

SEQ ID NO: 844544 - DNA, 20 bp, mouse
ggcccgcagctccacgccgg

SEQ ID NO: 844545 - DNA, 20 bp, mouse
ggaccctcatcgcctcacaa

SEQ ID NO: 844546 - DNA, 20 bp, mouse
ggggccgctctccaatgacc

SEQ ID NO: 844547 - DNA, 20 bp, mouse
gtctccgagaggatgggcta

SEQ ID NO: 844548 - DNA, 20 bp, mouse
gggaagatgacgtgcagcgc

SEQ ID NO: 844549 - DNA, 20 bp, mouse
ggaaggcgagacgactccca

SEQ ID NO: 844550 - DNA, 20 bp, mouse
gggaaaaagcccagagcgtt

SEQ ID NO: 844551 - DNA, 20 bp, mouse
gcatggttctccgagaggat

SEQ ID NO: 844552 - DNA, 20 bp, mouse
gaggcgcagaggcgcgtcgc

SEQ ID NO: 844553 - DNA, 20 bp, mouse
ggatgggctacggggcgcta

SEQ ID NO: 844554 - DNA, 20 bp, mouse
ggaaacaagaagcgatccct

SEQ ID NO: 844555 - DNA, 20 bp, mouse
gccggggctcgggaccgatc

SEQ ID NO: 844556 - DNA, 20 bp, mouse
gccgccgcaagccacgtgac

SEQ ID NO: 844557 - DNA, 20 bp, mouse
gcggggccgccggacggagt

SEQ ID NO: 844558 - DNA, 20 bp, mouse
gcccatgtgggagttcctca

SEQ ID NO: 844559 - DNA, 20 bp, mouse
gaggaactcccacatggggc

SEQ ID NO: 844560 - DNA, 20 bp, mouse
gcggcggccccgccccatgt

SEQ ID NO: 844561 - DNA, 20 bp, mouse
gggaaggccgatcttccggg

SEQ ID NO: 844562 - DNA, 20 bp, mouse
gcctgccgagggtcccacgc

SEQ ID NO: 844563 - DNA, 20 bp, mouse
gatggggcggggccgccgga

SEQ ID NO: 844564 - DNA, 20 bp, mouse
ggagggggaagcggcgtgac

SEQ ID NO: 844565 - DNA, 20 bp, mouse
gcggcggcgcagactccttc

SEQ ID NO: 844566 - DNA, 20 bp, mouse
gtgggtcatgtgggcggaag

SEQ ID NO: 844567 - DNA, 20 bp, mouse
gaaagcaggcaccggagcat

SEQ ID NO: 844568 - DNA, 20 bp, mouse
gtcatgtgggcggaagaggc

SEQ ID NO: 844569 - DNA, 20 bp, mouse
gcaggatgtgtgggtcatgt

SEQ ID NO: 844570 - DNA, 20 bp, mouse
gactacacgtgaggaaaagc

SEQ ID NO: 844571 - DNA, 20 bp, mouse
gaactgcacgactgacaatc

SEQ ID NO: 844572 - DNA, 20 bp, mouse
gaacgaaaatcaagaccaac

SEQ ID NO: 844573 - DNA, 20 bp, mouse
ggcggcactaactacacgtg

SEQ ID NO: 844574 - DNA, 20 bp, mouse
gtttttgctacatgagaagt

SEQ ID NO: 844575 - DNA, 20 bp, mouse
ggccgccatgttggaaagcc

SEQ ID NO: 844576 - DNA, 20 bp, mouse
gaaagctcgcgctaggaagt

SEQ ID NO: 844577 - DNA, 20 bp, mouse
gggagtgcgcaaattggcgc

SEQ ID NO: 844578 - DNA, 20 bp, mouse
ggccccctaaagctcgcgct

SEQ ID NO: 844579 - DNA, 20 bp, mouse
gtcctagcgcgagctttagg

SEQ ID NO: 844580 - DNA, 20 bp, mouse
ggcgaactacagaatccgag

SEQ ID NO: 844581 - DNA, 20 bp, mouse
gtgcgcaaattggcgcaggt

SEQ ID NO: 844582 - DNA, 20 bp, mouse
gagcctcggagtgcgcaaat

SEQ ID NO: 844583 - DNA, 20 bp, mouse
ggaggcgggctgtggaaata

SEQ ID NO: 844584 - DNA, 20 bp, mouse
gaactacagaatccgagagg

SEQ ID NO: 844585 - DNA, 20 bp, mouse
gaataagggagtgtacttcc

SEQ ID NO: 844586 - DNA, 20 bp, mouse
ggggcgccctgccgacgcgt

SEQ ID NO: 844587 - DNA, 20 bp, mouse
ggctgcgcggagagcaccct

SEQ ID NO: 844588 - DNA, 20 bp, mouse
gcgaatgaaaacttccgggt

SEQ ID NO: 844589 - DNA, 20 bp, mouse
ggtagccacaaaaggatccg

SEQ ID NO: 844590 - DNA, 20 bp, mouse
gccggcgaatgaaaacttcc

SEQ ID NO: 844591 - DNA, 20 bp, mouse
gggcgtccctggcgggattc

SEQ ID NO: 844592 - DNA, 20 bp, mouse
ggggtaggaacgctaggcca

SEQ ID NO: 844593 - DNA, 20 bp, mouse
gcgcggaacggaaatatcct

SEQ ID NO: 844594 - DNA, 20 bp, mouse
gcgggattccggcttcacgc

SEQ ID NO: 844595 - DNA, 20 bp, mouse
gcgtcggcagggcgcccact

SEQ ID NO: 844596 - DNA, 20 bp, mouse
gcctccctgtggttgactat

SEQ ID NO: 844597 - DNA, 20 bp, mouse
ggggctaaatcctcgcgcct

SEQ ID NO: 844598 - DNA, 20 bp, mouse
gtcctcccggaatacctgat

SEQ ID NO: 844599 - DNA, 20 bp, mouse
gaaccacagggaggcgacag

SEQ ID NO: 844600 - DNA, 20 bp, mouse
gagccgctgtcgcctccctg

SEQ ID NO: 844601 - DNA, 20 bp, mouse
ggaaaagaggggctccccaa

SEQ ID NO: 844602 - DNA, 20 bp, mouse
gagaagcgagaacctgcgac

SEQ ID NO: 844603 - DNA, 20 bp, mouse
gggctccccaatggcggaag

SEQ ID NO: 844604 - DNA, 20 bp, mouse
gcagctgccctggtcttagt

SEQ ID NO: 844605 - DNA, 20 bp, mouse
ggggaatgcatcttttgcgg

SEQ ID NO: 844606 - DNA, 20 bp, mouse
gaactcacatcccacgtgct

SEQ ID NO: 844607 - DNA, 20 bp, mouse
ggaccctgctttaacataaa

SEQ ID NO: 844608 - DNA, 20 bp, mouse
ggtgagttcaggggaaccct

SEQ ID NO: 844609 - DNA, 20 bp, mouse
ggtgcacatgtgaaaggggt

SEQ ID NO: 844610 - DNA, 20 bp, mouse
gggtctctgtttgaacccca

SEQ ID NO: 844611 - DNA, 20 bp, mouse
gctaagacacagttacggag

SEQ ID NO: 844612 - DNA, 20 bp, mouse
gggcatctgcacggatactg

SEQ ID NO: 844613 - DNA, 20 bp, mouse
gctgcacggatactgaggtg

SEQ ID NO: 844614 - DNA, 20 bp, mouse
gagacctgtgccagaagcaa

SEQ ID NO: 844615 - DNA, 20 bp, mouse
gtgcagatgcccggcacatt

SEQ ID NO: 844616 - DNA, 20 bp, mouse
ggttgactggtgttcagagt

SEQ ID NO: 844617 - DNA, 20 bp, mouse
gaatttactggcttgttgac

SEQ ID NO: 844618 - DNA, 20 bp, mouse
gtttttggaggggacgtatg

SEQ ID NO: 844619 - DNA, 20 bp, mouse
gaatgttagcagaagcgatg

SEQ ID NO: 844620 - DNA, 20 bp, mouse
gtcatagacaataaatttac

SEQ ID NO: 844621 - DNA, 20 bp, mouse
gggtatgacgtgaaatatct

SEQ ID NO: 844622 - DNA, 20 bp, mouse
gtcagagtaaggtttcctta

SEQ ID NO: 844623 - DNA, 20 bp, mouse
gcacaggatgatagataaaa

SEQ ID NO: 844624 - DNA, 20 bp, mouse
gtggatagtacccagcaagg

SEQ ID NO: 844625 - DNA, 20 bp, mouse
gtgggtactatccagcccta

SEQ ID NO: 844626 - DNA, 20 bp, mouse
gagactggctacacactcca

SEQ ID NO: 844627 - DNA, 20 bp, mouse
gtggctacacactccatggc

SEQ ID NO: 844628 - DNA, 20 bp, mouse
gtgcctgcatttagtgaaat

SEQ ID NO: 844629 - DNA, 20 bp, mouse
gtgcccatttcactaaatgc

SEQ ID NO: 844630 - DNA, 20 bp, mouse
ggtcaacatgattcactgtc

SEQ ID NO: 844631 - DNA, 20 bp, mouse
ggtgctaaggttgaaaacgt

SEQ ID NO: 844632 - DNA, 20 bp, mouse
gggaaatagaatgtgtacgt

SEQ ID NO: 844633 - DNA, 20 bp, mouse
gcaaccaaaaggctgaaagt

SEQ ID NO: 844634 - DNA, 20 bp, mouse
ggtctggagaagcgacagac

SEQ ID NO: 844635 - DNA, 20 bp, mouse
gaagcccaaagcaactattc

SEQ ID NO: 844636 - DNA, 20 bp, mouse
gggaaatggggctctatctg

SEQ ID NO: 844637 - DNA, 20 bp, mouse
gtgacacaaaagggattctt

SEQ ID NO: 844638 - DNA, 20 bp, mouse
ggtgaggtgtaggtcagagt

SEQ ID NO: 844639 - DNA, 20 bp, mouse
gcacaaaagggattctttgg

SEQ ID NO: 844640 - DNA, 20 bp, mouse
gtggggacagcgggtcctaa

SEQ ID NO: 844641 - DNA, 20 bp, mouse
gtccaacaggagacaggact

SEQ ID NO: 844642 - DNA, 20 bp, mouse
gctgggtagttgacacaaaa

SEQ ID NO: 844643 - DNA, 20 bp, mouse
gaatggctctagggtcctcc

SEQ ID NO: 844644 - DNA, 20 bp, mouse
gtccttcacagaggctgtta

SEQ ID NO: 844645 - DNA, 20 bp, mouse
ggcgggtcctaatggctcta

SEQ ID NO: 844646 - DNA, 20 bp, mouse
ggtcggtaggtagagctctt

SEQ ID NO: 844647 - DNA, 20 bp, mouse
gagggtctggatatctagtg

SEQ ID NO: 844648 - DNA, 20 bp, mouse
gccacagtgaaattagtttt

SEQ ID NO: 844649 - DNA, 20 bp, mouse
gtaacagaaggtgttctgta

SEQ ID NO: 844650 - DNA, 20 bp, mouse
gaggttatggacgttacgtg

SEQ ID NO: 844651 - DNA, 20 bp, mouse
gaaagtcacgtgggataaaa

SEQ ID NO: 844652 - DNA, 20 bp, mouse
gacgacccagttactcattg

SEQ ID NO: 844653 - DNA, 20 bp, mouse
gtaatttcactgtggtcggt

SEQ ID NO: 844654 - DNA, 20 bp, mouse
ggtagcaagtttagctgcac

SEQ ID NO: 844655 - DNA, 20 bp, mouse
ggtatagcaattaaatgaaa

SEQ ID NO: 844656 - DNA, 20 bp, mouse
gtcgtcggccgcaatggcta

SEQ ID NO: 844657 - DNA, 20 bp, mouse
ggaaagggccaattaggctg

SEQ ID NO: 844658 - DNA, 20 bp, mouse
gcgtccgtcgtcggccgcaa

SEQ ID NO: 844659 - DNA, 20 bp, mouse
gaatagggaaagggccaatt

SEQ ID NO: 844660 - DNA, 20 bp, mouse
gtggccaatagcacgtccct

SEQ ID NO: 844661 - DNA, 20 bp, mouse
gcctccgcccctagccattg

SEQ ID NO: 844662 - DNA, 20 bp, mouse
gctaggggcggagggactct

SEQ ID NO: 844663 - DNA, 20 bp, mouse
gcggccgcaatggctagggg

SEQ ID NO: 844664 - DNA, 20 bp, mouse
gcgacgacggacgggcccac

SEQ ID NO: 844665 - DNA, 20 bp, mouse
gcggccaagggacgtgctat

SEQ ID NO: 844666 - DNA, 20 bp, mouse
gaagacccgcggcgcaggag

SEQ ID NO: 844667 - DNA, 20 bp, mouse
ggggcccggcaagttcttaa

SEQ ID NO: 844668 - DNA, 20 bp, mouse
ggtgacgcaacgctcctcca

SEQ ID NO: 844669 - DNA, 20 bp, mouse
ggaaagggactggaccagag

SEQ ID NO: 844670 - DNA, 20 bp, mouse
gcctgcgggccgtgtcaccg

SEQ ID NO: 844671 - DNA, 20 bp, mouse
gggtcaggagtatgagactg

SEQ ID NO: 844672 - DNA, 20 bp, mouse
ggaccagagcgggcgcgtcg

SEQ ID NO: 844673 - DNA, 20 bp, mouse
gctggggtggacaactgacc

SEQ ID NO: 844674 - DNA, 20 bp, mouse
gtccaggcaaatgacggaga

SEQ ID NO: 844675 - DNA, 20 bp, mouse
gcaccgcgacgcgcccgctc

SEQ ID NO: 844676 - DNA, 20 bp, mouse
ggatgggtgggcacagtggg

SEQ ID NO: 844677 - DNA, 20 bp, mouse
gtgcgcttgcggggaaaagg

SEQ ID NO: 844678 - DNA, 20 bp, mouse
gcgctcgcgcggctgggtcc

SEQ ID NO: 844679 - DNA, 20 bp, mouse
ggccgccgcgcattgtgctg

SEQ ID NO: 844680 - DNA, 20 bp, mouse
ggtgtcaatcaaccagggat

SEQ ID NO: 844681 - DNA, 20 bp, mouse
gtgagggcggggcacggctg

SEQ ID NO: 844682 - DNA, 20 bp, mouse
ggctaccccagcagcgaaaa

SEQ ID NO: 844683 - DNA, 20 bp, mouse
gggcggggcacggctgtggg

SEQ ID NO: 844684 - DNA, 20 bp, mouse
ggggtggggctggtgcacgg

SEQ ID NO: 844685 - DNA, 20 bp, mouse
gcactgcgcttgcggggaaa

SEQ ID NO: 844686 - DNA, 20 bp, mouse
gagctggcgggagactggtt

SEQ ID NO: 844687 - DNA, 20 bp, mouse
gggaagatgcacttagggga

SEQ ID NO: 844688 - DNA, 20 bp, mouse
gggagggtggacttacagga

SEQ ID NO: 844689 - DNA, 20 bp, mouse
gggatcctatggatctagat

SEQ ID NO: 844690 - DNA, 20 bp, mouse
gcaggcccatctagatccat

SEQ ID NO: 844691 - DNA, 20 bp, mouse
gtgtgggaagatgcacttag

SEQ ID NO: 844692 - DNA, 20 bp, mouse
gcacgccgcggtctgccagc

SEQ ID NO: 844693 - DNA, 20 bp, mouse
gtcgcgagctggcgggagac

SEQ ID NO: 844694 - DNA, 20 bp, mouse
gcggggcctgagtgaatcct

SEQ ID NO: 844695 - DNA, 20 bp, mouse
gtggaggtagcaggatccta

SEQ ID NO: 844696 - DNA, 20 bp, mouse
ggtaagagtaggagtaggga

SEQ ID NO: 844697 - DNA, 20 bp, mouse
gtagtctctgtgaatctgag

SEQ ID NO: 844698 - DNA, 20 bp, mouse
gacataagaggtaataagaa

SEQ ID NO: 844699 - DNA, 20 bp, mouse
gtcaaagcgttatttcattt

SEQ ID NO: 844700 - DNA, 20 bp, mouse
gcctcttatgtccatttaac

SEQ ID NO: 844701 - DNA, 20 bp, mouse
gaatatgtaagagtaggagt

SEQ ID NO: 844702 - DNA, 20 bp, mouse
gggtctggcaataaatgaaa

SEQ ID NO: 844703 - DNA, 20 bp, mouse
gatagtaagaatatttggtc

SEQ ID NO: 844704 - DNA, 20 bp, mouse
ggatttatagtaagaatatt

SEQ ID NO: 844705 - DNA, 20 bp, mouse
gagtagggaaggattctcaa

SEQ ID NO: 844706 - DNA, 20 bp, mouse
ggccatgcaaatatatctcg

SEQ ID NO: 844707 - DNA, 20 bp, mouse
gcaaagataagtgataagta

SEQ ID NO: 844708 - DNA, 20 bp, mouse
gaaaacgggtgtcattttgt

SEQ ID NO: 844709 - DNA, 20 bp, mouse
gcccgttttaacacaccata

SEQ ID NO: 844710 - DNA, 20 bp, mouse
ggcctcgagatatatttgca

SEQ ID NO: 844711 - DNA, 20 bp, mouse
gaccatatggtgtgttaaaa

SEQ ID NO: 844712 - DNA, 20 bp, mouse
gtttgcatataaataaagag

SEQ ID NO: 844713 - DNA, 20 bp, mouse
gtattttcttctcttgatca

SEQ ID NO: 844714 - DNA, 20 bp, mouse
gttgcctggagaacaataca

SEQ ID NO: 844715 - DNA, 20 bp, mouse
gtgtccatgtattgttctcc

SEQ ID NO: 844716 - DNA, 20 bp, mouse
gtctggcagtgagcctgaaa

SEQ ID NO: 844717 - DNA, 20 bp, mouse
gccagcagcaggtgaagagt

SEQ ID NO: 844718 - DNA, 20 bp, mouse
gcccgctctgcgcaaagctc

SEQ ID NO: 844719 - DNA, 20 bp, mouse
ggacctgagtaacatggccg

SEQ ID NO: 844720 - DNA, 20 bp, mouse
gaggtggtgggagccgtttc

SEQ ID NO: 844721 - DNA, 20 bp, mouse
gaccagctcccgccaggaac

SEQ ID NO: 844722 - DNA, 20 bp, mouse
ggggacccccacatggtgag

SEQ ID NO: 844723 - DNA, 20 bp, mouse
ggggcggaaccttcggtcgg

SEQ ID NO: 844724 - DNA, 20 bp, mouse
gggtggatccctgacaagtg

SEQ ID NO: 844725 - DNA, 20 bp, mouse
gcctgctgctggcttcggtg

SEQ ID NO: 844726 - DNA, 20 bp, mouse
gcataaaaggtctaactcag

SEQ ID NO: 844727 - DNA, 20 bp, mouse
gtcactgaccaatacaaaag

SEQ ID NO: 844728 - DNA, 20 bp, mouse
gggtaattgctgtagttgtg

SEQ ID NO: 844729 - DNA, 20 bp, mouse
gaaaaggtctaactcagcgg

SEQ ID NO: 844730 - DNA, 20 bp, mouse
ggcggagacagagtttgagc

SEQ ID NO: 844731 - DNA, 20 bp, mouse
gttagacgctggaatccaac

SEQ ID NO: 844732 - DNA, 20 bp, mouse
gggcagggatggtgacgggg

SEQ ID NO: 844733 - DNA, 20 bp, mouse
gagggatgaagttcgtgata

SEQ ID NO: 844734 - DNA, 20 bp, mouse
gtagcaggccatttctcacg

SEQ ID NO: 844735 - DNA, 20 bp, mouse
gtagacatgaccacgcctct

SEQ ID NO: 844736 - DNA, 20 bp, mouse
gcagcccggggcttggtgaa

SEQ ID NO: 844737 - DNA, 20 bp, mouse
gtctcagctgtgggatgcaa

SEQ ID NO: 844738 - DNA, 20 bp, mouse
ggcagaaagcagaggcctct

SEQ ID NO: 844739 - DNA, 20 bp, mouse
gtgggatgcaagggaatttc

SEQ ID NO: 844740 - DNA, 20 bp, mouse
gaaatactgccacaggggag

SEQ ID NO: 844741 - DNA, 20 bp, mouse
gcaagacactgctgttccta

SEQ ID NO: 844742 - DNA, 20 bp, mouse
gataaacccagcttctgctg

SEQ ID NO: 844743 - DNA, 20 bp, mouse
gaacccctctggctttgatc

SEQ ID NO: 844744 - DNA, 20 bp, mouse
gtatttctgagtctcagctg

SEQ ID NO: 844745 - DNA, 20 bp, mouse
gtgcaagggaatttctggaa

SEQ ID NO: 844746 - DNA, 20 bp, mouse
gaaaagaggcaggtgccttg

SEQ ID NO: 844747 - DNA, 20 bp, mouse
gcggggcgctgcagggccgg

SEQ ID NO: 844748 - DNA, 20 bp, mouse
gataagggaggatgtattgg

SEQ ID NO: 844749 - DNA, 20 bp, mouse
ggggccgggggtcgcctagt

SEQ ID NO: 844750 - DNA, 20 bp, mouse
gcaacccactgccgccccca

SEQ ID NO: 844751 - DNA, 20 bp, mouse
gcccacagccagacccaact

SEQ ID NO: 844752 - DNA, 20 bp, mouse
gaggtcgtaggatgagacgt

SEQ ID NO: 844753 - DNA, 20 bp, mouse
ggcaggcgacacgtcgcaag

SEQ ID NO: 844754 - DNA, 20 bp, mouse
ggctgtatggatttcggttg

SEQ ID NO: 844755 - DNA, 20 bp, mouse
gcgtcgcaagcggaccgcgg

SEQ ID NO: 844756 - DNA, 20 bp, mouse
gagtgggcgggcgttctcgg

SEQ ID NO: 844757 - DNA, 20 bp, mouse
ggcagcgcgggctgtcacct

SEQ ID NO: 844758 - DNA, 20 bp, mouse
gagcgccggcgctgacgagt

SEQ ID NO: 844759 - DNA, 20 bp, mouse
gacgagtgggcgggcgttct

SEQ ID NO: 844760 - DNA, 20 bp, mouse
ggcgactaagagcgcgtcgc

SEQ ID NO: 844761 - DNA, 20 bp, mouse
gctgtcacctcggagcagag

SEQ ID NO: 844762 - DNA, 20 bp, mouse
gggcgggataggaatcgagc

SEQ ID NO: 844763 - DNA, 20 bp, mouse
ggctacttcagcgcaagctc

SEQ ID NO: 844764 - DNA, 20 bp, mouse
gtctcggtggacaagtgggc

SEQ ID NO: 844765 - DNA, 20 bp, mouse
gcccgcccactcgtcagcgc

SEQ ID NO: 844766 - DNA, 20 bp, mouse
gaggggacatgttcaggcaa

SEQ ID NO: 844767 - DNA, 20 bp, mouse
gcgctccgggtcttgtcttc

SEQ ID NO: 844768 - DNA, 20 bp, mouse
gctcccgggttcaagaaaga

SEQ ID NO: 844769 - DNA, 20 bp, mouse
ggagcacgtgggttgtacat

SEQ ID NO: 844770 - DNA, 20 bp, mouse
gtcctggagagggcgcaagg

SEQ ID NO: 844771 - DNA, 20 bp, mouse
ggaacccgggagaatccccc

SEQ ID NO: 844772 - DNA, 20 bp, mouse
gaaccccgggggattctccc

SEQ ID NO: 844773 - DNA, 20 bp, mouse
gaacccacgtgctcctccat

SEQ ID NO: 844774 - DNA, 20 bp, mouse
ggaagcgatcgacccgctca

SEQ ID NO: 844775 - DNA, 20 bp, mouse
gcagcagagcggagcggtgg

SEQ ID NO: 844776 - DNA, 20 bp, mouse
gctggggtgtcatcggaaat

SEQ ID NO: 844777 - DNA, 20 bp, mouse
gcggacgcctgtggcccggt

SEQ ID NO: 844778 - DNA, 20 bp, mouse
gcccgtggggcgcctcctac

SEQ ID NO: 844779 - DNA, 20 bp, mouse
ggcaaaccgaaagcggtgac

SEQ ID NO: 844780 - DNA, 20 bp, mouse
gacaccccagcctggtgaat

SEQ ID NO: 844781 - DNA, 20 bp, mouse
gagcggtgacaggacccgtg

SEQ ID NO: 844782 - DNA, 20 bp, mouse
ggtccccaattcaccaggct

SEQ ID NO: 844783 - DNA, 20 bp, mouse
gggcccgcagcccaagaggg

SEQ ID NO: 844784 - DNA, 20 bp, mouse
ggtcccgggcaaaccgaaag

SEQ ID NO: 844785 - DNA, 20 bp, mouse
gtctcagaggtgcccgtccc

SEQ ID NO: 844786 - DNA, 20 bp, mouse
ggagtcgcgggatggtcagg

SEQ ID NO: 844787 - DNA, 20 bp, mouse
gaaagcttaagcaacagggt

SEQ ID NO: 844788 - DNA, 20 bp, mouse
gcccgcgactccagccactc

SEQ ID NO: 844789 - DNA, 20 bp, mouse
gactaggaggacggcagcag

SEQ ID NO: 844790 - DNA, 20 bp, mouse
gtgtgtggcaggagccggag

SEQ ID NO: 844791 - DNA, 20 bp, mouse
gaaacctgcagttacgtgtg

SEQ ID NO: 844792 - DNA, 20 bp, mouse
gtgtttgggaggagactagg

SEQ ID NO: 844793 - DNA, 20 bp, mouse
ggcttaagcaacagggttgg

SEQ ID NO: 844794 - DNA, 20 bp, mouse
gcaggcgaagataccttgtt

SEQ ID NO: 844795 - DNA, 20 bp, mouse
gctgccacacacgtaactgc

SEQ ID NO: 844796 - DNA, 20 bp, mouse
gcccacctgcagcggagggc

SEQ ID NO: 844797 - DNA, 20 bp, mouse
gccggcccacctgcagcgga

SEQ ID NO: 844798 - DNA, 20 bp, mouse
gagcgctcgcagctcttggc

SEQ ID NO: 844799 - DNA, 20 bp, mouse
gcgcgtgcgtgtgtgatctt

SEQ ID NO: 844800 - DNA, 20 bp, mouse
ggcgctgcgggccccgctgc

SEQ ID NO: 844801 - DNA, 20 bp, mouse
gcggccgcgccgggctagca

SEQ ID NO: 844802 - DNA, 20 bp, mouse
gccccgccctccgctgcagg

SEQ ID NO: 844803 - DNA, 20 bp, mouse
gccgcagcgctcgcagctct

SEQ ID NO: 844804 - DNA, 20 bp, mouse
ggcgccgggctagcagggct

SEQ ID NO: 844805 - DNA, 20 bp, mouse
gcagcagagaccagcggccg

SEQ ID NO: 844806 - DNA, 20 bp, mouse
gctgctgcgtccattgtctg

SEQ ID NO: 844807 - DNA, 20 bp, mouse
ggatcctgggaatccgctcc

SEQ ID NO: 844808 - DNA, 20 bp, mouse
gcctgcgccctctggatcct

SEQ ID NO: 844809 - DNA, 20 bp, mouse
gaatggacgcagcagcggga

SEQ ID NO: 844810 - DNA, 20 bp, mouse
gcgctcctggcttccagacc

SEQ ID NO: 844811 - DNA, 20 bp, mouse
gcatggccaggcgcagggct

SEQ ID NO: 844812 - DNA, 20 bp, mouse
gaagccaggagcggattccc

SEQ ID NO: 844813 - DNA, 20 bp, mouse
gagagccgggccgcagacaa

SEQ ID NO: 844814 - DNA, 20 bp, mouse
ggggcggggagagagctccc

SEQ ID NO: 844815 - DNA, 20 bp, mouse
ggggaaaggttttcaatcgg

SEQ ID NO: 844816 - DNA, 20 bp, mouse
gggagctgcggccaagtcgg

SEQ ID NO: 844817 - DNA, 20 bp, mouse
gccctccgggcctaactggg

SEQ ID NO: 844818 - DNA, 20 bp, mouse
gccgccctccgggcctaact

SEQ ID NO: 844819 - DNA, 20 bp, mouse
gcccggagctgcggccaagt

SEQ ID NO: 844820 - DNA, 20 bp, mouse
ggtgcacggcgccccgggaa

SEQ ID NO: 844821 - DNA, 20 bp, mouse
ggcagtgcgcgtggccgcgg

SEQ ID NO: 844822 - DNA, 20 bp, mouse
gcggcctggagccctcgtgc

SEQ ID NO: 844823 - DNA, 20 bp, mouse
gctccgtagagcagggtcgg

SEQ ID NO: 844824 - DNA, 20 bp, mouse
gggcgcggcgcccggagctg

SEQ ID NO: 844825 - DNA, 20 bp, mouse
gcgcctgcgcacctccgact

SEQ ID NO: 844826 - DNA, 20 bp, mouse
ggcacagaccgggcggtaga

SEQ ID NO: 844827 - DNA, 20 bp, mouse
gcgcatgcgcagggtgttca

SEQ ID NO: 844828 - DNA, 20 bp, mouse
gcctcctcccaagcctcgag

SEQ ID NO: 844829 - DNA, 20 bp, mouse
ggggcggagcttccgagaca

SEQ ID NO: 844830 - DNA, 20 bp, mouse
ggtgttcagggccactgcgc

SEQ ID NO: 844831 - DNA, 20 bp, mouse
gcagaccgggcggtagaggg

SEQ ID NO: 844832 - DNA, 20 bp, mouse
ggaggccacgccccctgtct

SEQ ID NO: 844833 - DNA, 20 bp, mouse
ggcgtggcctctcgaggctt

SEQ ID NO: 844834 - DNA, 20 bp, mouse
gccggtctgtgcctgcgcag

SEQ ID NO: 844835 - DNA, 20 bp, mouse
ggggctccggcagtggccag

SEQ ID NO: 844836 - DNA, 20 bp, mouse
gtgtgcgtgcgcgatcccga

SEQ ID NO: 844837 - DNA, 20 bp, mouse
gaacgtgcgctgtcacaaag

SEQ ID NO: 844838 - DNA, 20 bp, mouse
ggggccgcgcacggaccctc

SEQ ID NO: 844839 - DNA, 20 bp, mouse
gctcccgctgcgggagaacg

SEQ ID NO: 844840 - DNA, 20 bp, mouse
gcggccgcgttctcccgcag

SEQ ID NO: 844841 - DNA, 20 bp, mouse
gccaccccggccgccctgtg

SEQ ID NO: 844842 - DNA, 20 bp, mouse
gccctgcgaggacccgagtc

SEQ ID NO: 844843 - DNA, 20 bp, mouse
gcggccccacagggcggccg

SEQ ID NO: 844844 - DNA, 20 bp, mouse
gctgccggacgggtcaagca

SEQ ID NO: 844845 - DNA, 20 bp, mouse
gggctcgtgcagcacggaga

SEQ ID NO: 844846 - DNA, 20 bp, mouse
ggaagcgggtatcactgcgt

SEQ ID NO: 844847 - DNA, 20 bp, mouse
gcacctcgccatgcacctat

SEQ ID NO: 844848 - DNA, 20 bp, mouse
ggaggtgcgcgcgcatgcgt

SEQ ID NO: 844849 - DNA, 20 bp, mouse
gggtatcactgcgttgggta

SEQ ID NO: 844850 - DNA, 20 bp, mouse
ggcgttgggtagggaaacgc

SEQ ID NO: 844851 - DNA, 20 bp, mouse
gtaaaagactctcgctcctc

SEQ ID NO: 844852 - DNA, 20 bp, mouse
gcggctgatggtggtgacgc

SEQ ID NO: 844853 - DNA, 20 bp, mouse
gacgcccagctcccgcgcgt

SEQ ID NO: 844854 - DNA, 20 bp, mouse
gtatacaggacgcctggggt

SEQ ID NO: 844855 - DNA, 20 bp, mouse
gaaagctgcccgcccggggc

SEQ ID NO: 844856 - DNA, 20 bp, mouse
gtagtggcacacgtgtgaaa

SEQ ID NO: 844857 - DNA, 20 bp, mouse
ggcgcactgacctgatactc

SEQ ID NO: 844858 - DNA, 20 bp, mouse
gaccagtggtgggtgcgaga

SEQ ID NO: 844859 - DNA, 20 bp, mouse
gaggccgcttcaacatactg

SEQ ID NO: 844860 - DNA, 20 bp, mouse
gctaacatgcagttcagtag

SEQ ID NO: 844861 - DNA, 20 bp, mouse
gagtggcccttgaacttggt

SEQ ID NO: 844862 - DNA, 20 bp, mouse
gctaggggaacagcaccctc

SEQ ID NO: 844863 - DNA, 20 bp, mouse
gcaggtcagtgcgcggcaga

SEQ ID NO: 844864 - DNA, 20 bp, mouse
gggccactcactctgtctta

SEQ ID NO: 844865 - DNA, 20 bp, mouse
gccttgaacttggtgggcac

SEQ ID NO: 844866 - DNA, 20 bp, mouse
ggagaactgcagagttgcgg

SEQ ID NO: 844867 - DNA, 20 bp, mouse
gacacagcgcaaactcctgg

SEQ ID NO: 844868 - DNA, 20 bp, mouse
gaaagcgctggccctttaag

SEQ ID NO: 844869 - DNA, 20 bp, mouse
gagcgcggaaggaattgtgg

SEQ ID NO: 844870 - DNA, 20 bp, mouse
gcgcccacccggctcgacac

SEQ ID NO: 844871 - DNA, 20 bp, mouse
gaacttgtagctaggggctt

SEQ ID NO: 844872 - DNA, 20 bp, mouse
gcggaaggaattgtggcggt

SEQ ID NO: 844873 - DNA, 20 bp, mouse
gctagctacaagttattgca

SEQ ID NO: 844874 - DNA, 20 bp, mouse
gaaaaaggagcactggcaga

SEQ ID NO: 844875 - DNA, 20 bp, mouse
ggctccgtcccccccttaaa

SEQ ID NO: 844876 - DNA, 20 bp, mouse
gcgggaggggatacgagtta

SEQ ID NO: 844877 - DNA, 20 bp, mouse
gaggggcgggtcccgagctt

SEQ ID NO: 844878 - DNA, 20 bp, mouse
ggagctggagcgactgtcca

SEQ ID NO: 844879 - DNA, 20 bp, mouse
ggccgcattcggaacatcgg

SEQ ID NO: 844880 - DNA, 20 bp, mouse
gtggttccagggttcccggg

SEQ ID NO: 844881 - DNA, 20 bp, mouse
ggacccgcccctctttgttg

SEQ ID NO: 844882 - DNA, 20 bp, mouse
gttgctgcagaaggctgttg

SEQ ID NO: 844883 - DNA, 20 bp, mouse
gccagctccgcggggctccc

SEQ ID NO: 844884 - DNA, 20 bp, mouse
gctgctgcgcctctgcccga

SEQ ID NO: 844885 - DNA, 20 bp, mouse
gtcccaggatactgcagcat

SEQ ID NO: 844886 - DNA, 20 bp, mouse
ggggatctggaggtatatct

SEQ ID NO: 844887 - DNA, 20 bp, mouse
ggggcggggcttcctccaat

SEQ ID NO: 844888 - DNA, 20 bp, mouse
gactcctcactgggatctgg

SEQ ID NO: 844889 - DNA, 20 bp, mouse
gatacctccagatcccagtg

SEQ ID NO: 844890 - DNA, 20 bp, mouse
gggaccgtctgtaccgaggg

SEQ ID NO: 844891 - DNA, 20 bp, mouse
gtgacccattcagaggaggt

SEQ ID NO: 844892 - DNA, 20 bp, mouse
gagtgcaatgacccattcag

SEQ ID NO: 844893 - DNA, 20 bp, mouse
gacacccacctcctctgaat

SEQ ID NO: 844894 - DNA, 20 bp, mouse
gaagcagaggtagattgtag

SEQ ID NO: 844895 - DNA, 20 bp, mouse
gggcagactgggttggtcat

SEQ ID NO: 844896 - DNA, 20 bp, mouse
gttaaggcgcagggaattgt

SEQ ID NO: 844897 - DNA, 20 bp, mouse
gcctcgccggcgcaccccct

SEQ ID NO: 844898 - DNA, 20 bp, mouse
gcctcccggggaaggtgtgg

SEQ ID NO: 844899 - DNA, 20 bp, mouse
gcgggaaaggagtgcaattg

SEQ ID NO: 844900 - DNA, 20 bp, mouse
gcaactccggagtgaggctc

SEQ ID NO: 844901 - DNA, 20 bp, mouse
gtaggtgcagccggccgagg

SEQ ID NO: 844902 - DNA, 20 bp, mouse
gcacgccacaagaccgggaa

SEQ ID NO: 844903 - DNA, 20 bp, mouse
ggggatggagagcgtttaaa

SEQ ID NO: 844904 - DNA, 20 bp, mouse
gccccgcctggaggcgtcca

SEQ ID NO: 844905 - DNA, 20 bp, mouse
ggatcccctgcgatggaaag

SEQ ID NO: 844906 - DNA, 20 bp, mouse
gcacgcgtcaggaagagcgc

SEQ ID NO: 844907 - DNA, 20 bp, mouse
gcttcgcgggcggacttaaa

SEQ ID NO: 844908 - DNA, 20 bp, mouse
gaaaagactagcggtgcagg

SEQ ID NO: 844909 - DNA, 20 bp, mouse
gtctgctgaccgagctgcga

SEQ ID NO: 844910 - DNA, 20 bp, mouse
ggggcggggccttgctcggg

SEQ ID NO: 844911 - DNA, 20 bp, mouse
ggagggcgcgaaaagactag

SEQ ID NO: 844912 - DNA, 20 bp, mouse
gaagccccaccccccgagca

SEQ ID NO: 844913 - DNA, 20 bp, mouse
ggaagggcgggacacgcgtc

SEQ ID NO: 844914 - DNA, 20 bp, mouse
gagactagcggtgcaggtgg

SEQ ID NO: 844915 - DNA, 20 bp, mouse
ggcgaaaagactagcggtgc

SEQ ID NO: 844916 - DNA, 20 bp, mouse
gctagggcgcggctcctcta

SEQ ID NO: 844917 - DNA, 20 bp, mouse
gggggtggggcgctagggcg

SEQ ID NO: 844918 - DNA, 20 bp, mouse
gtggacagagacgaatgtct

SEQ ID NO: 844919 - DNA, 20 bp, mouse
gctacaatgggcaaatactt

SEQ ID NO: 844920 - DNA, 20 bp, mouse
gctaaggattacggcggagg

SEQ ID NO: 844921 - DNA, 20 bp, mouse
ggctactccaacccctacaa

SEQ ID NO: 844922 - DNA, 20 bp, mouse
ggctcctctaaggattacgg

SEQ ID NO: 844923 - DNA, 20 bp, mouse
gcccgcgggtaggcagggat

SEQ ID NO: 844924 - DNA, 20 bp, mouse
gcctctaaggattacggcgg

SEQ ID NO: 844925 - DNA, 20 bp, mouse
ggcggctcctctaaggatta

SEQ ID NO: 844926 - DNA, 20 bp, mouse
ggcccaggtctgctcagtgt

SEQ ID NO: 844927 - DNA, 20 bp, mouse
gcagtgagtggaagctgtga

SEQ ID NO: 844928 - DNA, 20 bp, mouse
gcaggtctgctcagtgtagg

SEQ ID NO: 844929 - DNA, 20 bp, mouse
gtggctgctgcaggggcaaa

SEQ ID NO: 844930 - DNA, 20 bp, mouse
gtaactgtcgccccggggtg

SEQ ID NO: 844931 - DNA, 20 bp, mouse
gcctcctggtccccagtcta

SEQ ID NO: 844932 - DNA, 20 bp, mouse
gagacaggaggtgacagcct

SEQ ID NO: 844933 - DNA, 20 bp, mouse
ggcccctgcagcagccaaaa

SEQ ID NO: 844934 - DNA, 20 bp, mouse
ggccgccgcctgccccagtg

SEQ ID NO: 844935 - DNA, 20 bp, mouse
gagatcagggccgtagactg

SEQ ID NO: 844936 - DNA, 20 bp, mouse
gtgcacctagggaaagtcgt

SEQ ID NO: 844937 - DNA, 20 bp, mouse
ggggccgccagcgaaagttg

SEQ ID NO: 844938 - DNA, 20 bp, mouse
gcgccagcgaaagttgagga

SEQ ID NO: 844939 - DNA, 20 bp, mouse
ggaaggcggggctcctgagc

SEQ ID NO: 844940 - DNA, 20 bp, mouse
gcggaccctggcaaggacag

SEQ ID NO: 844941 - DNA, 20 bp, mouse
gggtgcttgggtctccgggg

SEQ ID NO: 844942 - DNA, 20 bp, mouse
gtgggtctccggggaggtgc

SEQ ID NO: 844943 - DNA, 20 bp, mouse
gtgggaggacgggttggagg

SEQ ID NO: 844944 - DNA, 20 bp, mouse
gaggctggaggtctttcttg

SEQ ID NO: 844945 - DNA, 20 bp, mouse
ggaagaggccataggggcgt

SEQ ID NO: 844946 - DNA, 20 bp, mouse
gtggggcggcggccacaaag

SEQ ID NO: 844947 - DNA, 20 bp, mouse
ggggaggagcgggccgagtt

SEQ ID NO: 844948 - DNA, 20 bp, mouse
gtgcccgccgccctggctgg

SEQ ID NO: 844949 - DNA, 20 bp, mouse
gccgcccgcccgtgaaccct

SEQ ID NO: 844950 - DNA, 20 bp, mouse
gcacaaccccggggcgtcca

SEQ ID NO: 844951 - DNA, 20 bp, mouse
gagccccggacccccagcca

SEQ ID NO: 844952 - DNA, 20 bp, mouse
ggcggccacaaaggggatcc

SEQ ID NO: 844953 - DNA, 20 bp, mouse
ggcaagctccactcatccga

SEQ ID NO: 844954 - DNA, 20 bp, mouse
gtgtggccgccgccccaact

SEQ ID NO: 844955 - DNA, 20 bp, mouse
gccgcgcctccggggactcg

SEQ ID NO: 844956 - DNA, 20 bp, mouse
ggggaggcacaaagtgagtg

SEQ ID NO: 844957 - DNA, 20 bp, mouse
gcgggcgcagagcccctcgg

SEQ ID NO: 844958 - DNA, 20 bp, mouse
gaggtgacagccggactgtg

SEQ ID NO: 844959 - DNA, 20 bp, mouse
gtgtgtgtggcggcctccga

SEQ ID NO: 844960 - DNA, 20 bp, mouse
ggagactgctgaacgtggag

SEQ ID NO: 844961 - DNA, 20 bp, mouse
ggacagccggactgtggggc

SEQ ID NO: 844962 - DNA, 20 bp, mouse
ggtggccgggaggtgacagc

SEQ ID NO: 844963 - DNA, 20 bp, mouse
gcagtctcgagggaccgcgg

SEQ ID NO: 844964 - DNA, 20 bp, mouse
gggagaggagcgttgttacc

SEQ ID NO: 844965 - DNA, 20 bp, mouse
gccaagaatggggcggaggc

SEQ ID NO: 844966 - DNA, 20 bp, mouse
gcgcaacgggagttcgttca

SEQ ID NO: 844967 - DNA, 20 bp, mouse
ggactctgggtggatccagt

SEQ ID NO: 844968 - DNA, 20 bp, mouse
gggcgattgggcgcgagctg

SEQ ID NO: 844969 - DNA, 20 bp, mouse
gccagtaggcgcagcgcaac

SEQ ID NO: 844970 - DNA, 20 bp, mouse
gcgagagggaccaatgggta

SEQ ID NO: 844971 - DNA, 20 bp, mouse
gctcgcgcccaatcgccgac

SEQ ID NO: 844972 - DNA, 20 bp, mouse
gtaccctgagctaggactag

SEQ ID NO: 844973 - DNA, 20 bp, mouse
gcgacccggcagaaaagagg

SEQ ID NO: 844974 - DNA, 20 bp, mouse
gtaggaggaaaagagatatg

SEQ ID NO: 844975 - DNA, 20 bp, mouse
ggggcggtcttctgtaccac

SEQ ID NO: 844976 - DNA, 20 bp, mouse
ggtgactgacaagcttagaa

SEQ ID NO: 844977 - DNA, 20 bp, mouse
gtcattggtgcttacgtcgt

SEQ ID NO: 844978 - DNA, 20 bp, mouse
gtgcaggtggggctgcggtt

SEQ ID NO: 844979 - DNA, 20 bp, mouse
gaatgaatacgcagattcgc

SEQ ID NO: 844980 - DNA, 20 bp, mouse
gaagcttagaaaggatgtgt

SEQ ID NO: 844981 - DNA, 20 bp, mouse
gcgcagattcgcagggagag

SEQ ID NO: 844982 - DNA, 20 bp, mouse
gaagagactacactccagag

SEQ ID NO: 844983 - DNA, 20 bp, mouse
gttacgtcgtgggtggtgat

SEQ ID NO: 844984 - DNA, 20 bp, mouse
gatgtgttggaaaagccaga

SEQ ID NO: 844985 - DNA, 20 bp, mouse
gcactcagaatgaagttcac

SEQ ID NO: 844986 - DNA, 20 bp, mouse
gcagctgaaggggttaacgt

SEQ ID NO: 844987 - DNA, 20 bp, mouse
gtgaagtcattctgagtcct

SEQ ID NO: 844988 - DNA, 20 bp, mouse
gcggagggaaatcccttcaa

SEQ ID NO: 844989 - DNA, 20 bp, mouse
gtggaagtgtcgtgtttccc

SEQ ID NO: 844990 - DNA, 20 bp, mouse
gaggggttaacgtggggact

SEQ ID NO: 844991 - DNA, 20 bp, mouse
gggtcttgctagagaggcgg

SEQ ID NO: 844992 - DNA, 20 bp, mouse
gaagggtcttgctagagagg

SEQ ID NO: 844993 - DNA, 20 bp, mouse
gcatccagcaatgggtcaaa

SEQ ID NO: 844994 - DNA, 20 bp, mouse
gaagagtgactcatgataat

SEQ ID NO: 844995 - DNA, 20 bp, mouse
gtgacccattgctggatgac

SEQ ID NO: 844996 - DNA, 20 bp, mouse
gagactcagcgagaaggagg

SEQ ID NO: 844997 - DNA, 20 bp, mouse
gaggagactcagcgagaagg

SEQ ID NO: 844998 - DNA, 20 bp, mouse
gcaagcttggaaacaggcgg

SEQ ID NO: 844999 - DNA, 20 bp, mouse
gggtccctaccgcaggctga

SEQ ID NO: 845000 - DNA, 20 bp, mouse
gggcaggcggtccctaccgc

SEQ ID NO: 845001 - DNA, 20 bp, mouse
ggctccctcagcctgcggta

SEQ ID NO: 845002 - DNA, 20 bp, mouse
gaacaggcggaggggcggaa

SEQ ID NO: 845003 - DNA, 20 bp, mouse
gttggaaacaggcggagggg

SEQ ID NO: 845004 - DNA, 20 bp, mouse
gaggaggagactcagcgaga

SEQ ID NO: 845005 - DNA, 20 bp, mouse
gaccgcctgcctccctggcc

SEQ ID NO: 845006 - DNA, 20 bp, mouse
gaatccggtcgcaatccctg

SEQ ID NO: 845007 - DNA, 20 bp, mouse
gaatcccaggcccctccctt

SEQ ID NO: 845008 - DNA, 20 bp, mouse
gccccaaggcagagccgcta

SEQ ID NO: 845009 - DNA, 20 bp, mouse
ggcccctcccttgggaatgg

SEQ ID NO: 845010 - DNA, 20 bp, mouse
gtgggcgcggcgacgtgaga

SEQ ID NO: 845011 - DNA, 20 bp, mouse
gagagggcggggcgcctgtg

SEQ ID NO: 845012 - DNA, 20 bp, mouse
ggcgccgcagggattgcgac

SEQ ID NO: 845013 - DNA, 20 bp, mouse
gaccaataggagccacagtc

SEQ ID NO: 845014 - DNA, 20 bp, mouse
ggcaactcagagccggactg

SEQ ID NO: 845015 - DNA, 20 bp, mouse
gcgcggggcgctccttataa

SEQ ID NO: 845016 - DNA, 20 bp, mouse
gtcgaggaagcgtagtgctg

SEQ ID NO: 845017 - DNA, 20 bp, mouse
gtacgcttcctcgacggata

SEQ ID NO: 845018 - DNA, 20 bp, mouse
gcgggcacgagtcccaaggc

SEQ ID NO: 845019 - DNA, 20 bp, mouse
gtaggagaggcctcctccga

SEQ ID NO: 845020 - DNA, 20 bp, mouse
gccgagggataaagaggata

SEQ ID NO: 845021 - DNA, 20 bp, mouse
ggctggggagaggcacggag

SEQ ID NO: 845022 - DNA, 20 bp, mouse
ggtgctgcggccaattgacg

SEQ ID NO: 845023 - DNA, 20 bp, mouse
gcaagactccctatccgtcg

SEQ ID NO: 845024 - DNA, 20 bp, mouse
ggcctattgcctttgtcgat

SEQ ID NO: 845025 - DNA, 20 bp, mouse
gcctcctccgagggataaag

SEQ ID NO: 845026 - DNA, 20 bp, mouse
gcgactcgacgcacgcgggg

SEQ ID NO: 845027 - DNA, 20 bp, mouse
gaggaaggcactcggaaggt

SEQ ID NO: 845028 - DNA, 20 bp, mouse
ggaagaggaaggcactcgga

SEQ ID NO: 845029 - DNA, 20 bp, mouse
gcaaagcgactcgacgcacg

SEQ ID NO: 845030 - DNA, 20 bp, mouse
gacgttcggggcaacggcta

SEQ ID NO: 845031 - DNA, 20 bp, mouse
ggaagactctggttcccaga

SEQ ID NO: 845032 - DNA, 20 bp, mouse
gcgcctgcgcagtctcagtg

SEQ ID NO: 845033 - DNA, 20 bp, mouse
gtccggctcctctctcgcga

SEQ ID NO: 845034 - DNA, 20 bp, mouse
gtccttcgcgagagaggagc

SEQ ID NO: 845035 - DNA, 20 bp, mouse
gtgagtgtgagtgcggggtg

SEQ ID NO: 845036 - DNA, 20 bp, mouse
ggccgcgctctcgccctctg

SEQ ID NO: 845037 - DNA, 20 bp, mouse
ggggaagaagaccccgagac

SEQ ID NO: 845038 - DNA, 20 bp, mouse
gctgtccggggtggagccga

SEQ ID NO: 845039 - DNA, 20 bp, mouse
gcctgcgtgcactctggcac

SEQ ID NO: 845040 - DNA, 20 bp, mouse
gcggggcgatagggaggcgt

SEQ ID NO: 845041 - DNA, 20 bp, mouse
gacagcgcccagaccagtct

SEQ ID NO: 845042 - DNA, 20 bp, mouse
gaagaccccgagactggtct

SEQ ID NO: 845043 - DNA, 20 bp, mouse
gctggcacggggcgataggg

SEQ ID NO: 845044 - DNA, 20 bp, mouse
gcatgatcacagagccgcag

SEQ ID NO: 845045 - DNA, 20 bp, mouse
gggagcggcgcagatcgcgg

SEQ ID NO: 845046 - DNA, 20 bp, mouse
gtgctccggagtgaccacgt

SEQ ID NO: 845047 - DNA, 20 bp, mouse
ggcacccgcgcggtcaggat

SEQ ID NO: 845048 - DNA, 20 bp, mouse
ggtccgagaccgctcaccca

SEQ ID NO: 845049 - DNA, 20 bp, mouse
gtcgacccacgtggtcactc

SEQ ID NO: 845050 - DNA, 20 bp, mouse
gaccacgtgggtcgagagca

SEQ ID NO: 845051 - DNA, 20 bp, mouse
gcaacggcacccgcgcggtc

SEQ ID NO: 845052 - DNA, 20 bp, mouse
gggaccgtccggcggggacg

SEQ ID NO: 845053 - DNA, 20 bp, mouse
gtggtcactccggagcaggt

SEQ ID NO: 845054 - DNA, 20 bp, mouse
gcggcgcaacggcacccgcg

SEQ ID NO: 845055 - DNA, 20 bp, mouse
ggccgtgctctcgacccacg

SEQ ID NO: 845056 - DNA, 20 bp, mouse
gggcgcctaggccaactgtc

SEQ ID NO: 845057 - DNA, 20 bp, mouse
gcccgcccgcgccccttcag

SEQ ID NO: 845058 - DNA, 20 bp, mouse
ggcggggccccttgcacgtc

SEQ ID NO: 845059 - DNA, 20 bp, mouse
ggggtctgggagcgacactc

SEQ ID NO: 845060 - DNA, 20 bp, mouse
gagacccagggcgggctctg

SEQ ID NO: 845061 - DNA, 20 bp, mouse
gcgagtgcgcgggcgcagtg

SEQ ID NO: 845062 - DNA, 20 bp, mouse
gggccctgctggcgggtgac

SEQ ID NO: 845063 - DNA, 20 bp, mouse
ggcgcctcccggcccagcaa

SEQ ID NO: 845064 - DNA, 20 bp, mouse
gagggcgccagcagagaccc

SEQ ID NO: 845065 - DNA, 20 bp, mouse
gcctcagaccagacgtgcaa

SEQ ID NO: 845066 - DNA, 20 bp, mouse
ggtaacagagttaaacccta

SEQ ID NO: 845067 - DNA, 20 bp, mouse
gaccacaagaagctctgtcc

SEQ ID NO: 845068 - DNA, 20 bp, mouse
gtctgtcctggatgaagtca

SEQ ID NO: 845069 - DNA, 20 bp, mouse
gtaccccaaatgtcaaatct

SEQ ID NO: 845070 - DNA, 20 bp, mouse
gtggcttcaaggtcagattc

SEQ ID NO: 845071 - DNA, 20 bp, mouse
gtgtctgctcatcttcctta

SEQ ID NO: 845072 - DNA, 20 bp, mouse
ggtcctagatttgacatttg

SEQ ID NO: 845073 - DNA, 20 bp, mouse
ggtaccacatcaagatgtcc

SEQ ID NO: 845074 - DNA, 20 bp, mouse
gagaattccagtaaagaagg

SEQ ID NO: 845075 - DNA, 20 bp, mouse
gtaatctcctcattttattg

SEQ ID NO: 845076 - DNA, 20 bp, mouse
gtggaggccctgccttgtga

SEQ ID NO: 845077 - DNA, 20 bp, mouse
gaaccactgcactgtcgcct

SEQ ID NO: 845078 - DNA, 20 bp, mouse
gtcagaggactgaacttagt

SEQ ID NO: 845079 - DNA, 20 bp, mouse
gggtcctggagcccctcaca

SEQ ID NO: 845080 - DNA, 20 bp, mouse
ggaggcgtttacagcagatt

SEQ ID NO: 845081 - DNA, 20 bp, mouse
gctacatcacggatcatcac

SEQ ID NO: 845082 - DNA, 20 bp, mouse
gcacaggcgtctgccttccg

SEQ ID NO: 845083 - DNA, 20 bp, mouse
gcggggtcccgggtcaactc

SEQ ID NO: 845084 - DNA, 20 bp, mouse
gtggagcccctcacaaggca

SEQ ID NO: 845085 - DNA, 20 bp, mouse
ggggtagaaccacggcggca

SEQ ID NO: 845086 - DNA, 20 bp, mouse
gtacctgggtaggtcctgga

SEQ ID NO: 845087 - DNA, 20 bp, mouse
gagaatgttgtctgttctca

SEQ ID NO: 845088 - DNA, 20 bp, mouse
gcccaggtatgtgtgaggtc

SEQ ID NO: 845089 - DNA, 20 bp, mouse
gcacatacctgggtaggtcc

SEQ ID NO: 845090 - DNA, 20 bp, mouse
gtcctgacctcacacatacc

SEQ ID NO: 845091 - DNA, 20 bp, mouse
ggtccttagaagggtggtgt

SEQ ID NO: 845092 - DNA, 20 bp, mouse
gctttctagaagaagagagg

SEQ ID NO: 845093 - DNA, 20 bp, mouse
ggtctgttctcaaggcttcc

SEQ ID NO: 845094 - DNA, 20 bp, mouse
gtagctttaaattactttag

SEQ ID NO: 845095 - DNA, 20 bp, mouse
gttctaaggacaatagagaa

SEQ ID NO: 845096 - DNA, 20 bp, mouse
gaggccgtggaccctggtaa

SEQ ID NO: 845097 - DNA, 20 bp, mouse
gttaccggtgagaagcgcag

SEQ ID NO: 845098 - DNA, 20 bp, mouse
gttcctgagcccagtttgaa

SEQ ID NO: 845099 - DNA, 20 bp, mouse
gctaggggctccccgaaagg

SEQ ID NO: 845100 - DNA, 20 bp, mouse
gaaccccttaccagggtcca

SEQ ID NO: 845101 - DNA, 20 bp, mouse
gggagaaagtaggggttgga

SEQ ID NO: 845102 - DNA, 20 bp, mouse
gctggcgagcgaacagagag

SEQ ID NO: 845103 - DNA, 20 bp, mouse
gcgctccccggggcgggtct

SEQ ID NO: 845104 - DNA, 20 bp, mouse
gacggggagatcgtgaactt

SEQ ID NO: 845105 - DNA, 20 bp, mouse
ggccccggggagcggtctgg

SEQ ID NO: 845106 - DNA, 20 bp, mouse
gcccgccgctgcaggggaaa

SEQ ID NO: 845107 - DNA, 20 bp, mouse
gccccggagctcggcctcca

SEQ ID NO: 845108 - DNA, 20 bp, mouse
gtcgctgcctcacgagggga

SEQ ID NO: 845109 - DNA, 20 bp, mouse
gcgggcaacggggacggcgg

SEQ ID NO: 845110 - DNA, 20 bp, mouse
gcgccctggaggccgagctc

SEQ ID NO: 845111 - DNA, 20 bp, mouse
ggaaaggggacacaccgccc

SEQ ID NO: 845112 - DNA, 20 bp, mouse
gggacggcgggcaacgggga

SEQ ID NO: 845113 - DNA, 20 bp, mouse
gaggggacacaccgccctgg

SEQ ID NO: 845114 - DNA, 20 bp, mouse
ggcgggagggggcgtttgga

SEQ ID NO: 845115 - DNA, 20 bp, mouse
gggggtcgctgcctcacgag

SEQ ID NO: 845116 - DNA, 20 bp, mouse
gtggggctggaggaaagcgt

SEQ ID NO: 845117 - DNA, 20 bp, mouse
ggggctcaagtcaggtctgg

SEQ ID NO: 845118 - DNA, 20 bp, mouse
gcaggggctcaagtcaggtc

SEQ ID NO: 845119 - DNA, 20 bp, mouse
gtctgctggggtgtcggggt

SEQ ID NO: 845120 - DNA, 20 bp, mouse
ggggctctgctggggtgtcg

SEQ ID NO: 845121 - DNA, 20 bp, mouse
gctggaggaaagcgtggggc

SEQ ID NO: 845122 - DNA, 20 bp, mouse
gggagggagcaagcttccta

SEQ ID NO: 845123 - DNA, 20 bp, mouse
gaggggggagcaggtacagt

SEQ ID NO: 845124 - DNA, 20 bp, mouse
gtggccctggcaaccccttg

SEQ ID NO: 845125 - DNA, 20 bp, mouse
ggcttcctagggaaagagag

SEQ ID NO: 845126 - DNA, 20 bp, mouse
gtaagtctacagaggaagtc

SEQ ID NO: 845127 - DNA, 20 bp, mouse
gaactgctgtaagtctacag

SEQ ID NO: 845128 - DNA, 20 bp, mouse
gtagacttacagcagtttct

SEQ ID NO: 845129 - DNA, 20 bp, mouse
gaggcaggcatgtgtgaaag

SEQ ID NO: 845130 - DNA, 20 bp, mouse
gacttacagcagtttctcgg

SEQ ID NO: 845131 - DNA, 20 bp, mouse
gggcatgtgtgaaagaggtg

SEQ ID NO: 845132 - DNA, 20 bp, mouse
gggactcaccgtgtggtatc

SEQ ID NO: 845133 - DNA, 20 bp, mouse
gtagatctaacaattggcac

SEQ ID NO: 845134 - DNA, 20 bp, mouse
gtgctaccaaccagtaattt

SEQ ID NO: 845135 - DNA, 20 bp, mouse
gcgctgcatgacaagctcac

SEQ ID NO: 845136 - DNA, 20 bp, mouse
gcccgcgggcggtggggtca

SEQ ID NO: 845137 - DNA, 20 bp, mouse
gggcggcggggacgcccgga

SEQ ID NO: 845138 - DNA, 20 bp, mouse
ggtgcggcgtccccccccgc

SEQ ID NO: 845139 - DNA, 20 bp, mouse
gcgcccggagggggtcgaag

SEQ ID NO: 845140 - DNA, 20 bp, mouse
gccccaccgcccgcgggcac

SEQ ID NO: 845141 - DNA, 20 bp, mouse
gtgccgctgggggtatgaga

SEQ ID NO: 845142 - DNA, 20 bp, mouse
gatgctgcggtccgtggctc

SEQ ID NO: 845143 - DNA, 20 bp, mouse
gggctcaggcagctggagca

SEQ ID NO: 845144 - DNA, 20 bp, mouse
gtgagcagggaattccacta

SEQ ID NO: 845145 - DNA, 20 bp, mouse
ggcgacgccgccgggtacca

SEQ ID NO: 845146 - DNA, 20 bp, mouse
gagtagtcaggggatgtaaa

SEQ ID NO: 845147 - DNA, 20 bp, mouse
gggtgagcgtgtaggctgga

SEQ ID NO: 845148 - DNA, 20 bp, mouse
gagcgtgtaggctggagggg

SEQ ID NO: 845149 - DNA, 20 bp, mouse
gcggctcctgcccacctcgg

SEQ ID NO: 845150 - DNA, 20 bp, mouse
gctctctccaataggagctc

SEQ ID NO: 845151 - DNA, 20 bp, mouse
ggcacgagaggagatcgcag

SEQ ID NO: 845152 - DNA, 20 bp, mouse
ggacctgcttattggagaag

SEQ ID NO: 845153 - DNA, 20 bp, mouse
gaggcgccccctagtagtca

SEQ ID NO: 845154 - DNA, 20 bp, mouse
ggagaagagggtgagcgtgt

SEQ ID NO: 845155 - DNA, 20 bp, mouse
gagcgcccgggtccgccgga

SEQ ID NO: 845156 - DNA, 20 bp, mouse
gcgggcgggtgtctggtgga

SEQ ID NO: 845157 - DNA, 20 bp, mouse
ggaagcgggcgggtgtctgg

SEQ ID NO: 845158 - DNA, 20 bp, mouse
gggccctactgcgcaggtgc

SEQ ID NO: 845159 - DNA, 20 bp, mouse
gggagcgcgcggggtcacgt

SEQ ID NO: 845160 - DNA, 20 bp, mouse
ggtagggccctcggctagag

SEQ ID NO: 845161 - DNA, 20 bp, mouse
gacggtgaaagtccaatgat

SEQ ID NO: 845162 - DNA, 20 bp, mouse
gggaggataagcgtcgctcc

SEQ ID NO: 845163 - DNA, 20 bp, mouse
gcgcacgcccctctagccga

SEQ ID NO: 845164 - DNA, 20 bp, mouse
ggacgtcaatgttcattcat

SEQ ID NO: 845165 - DNA, 20 bp, mouse
gggcctgcacctgcgcagta

SEQ ID NO: 845166 - DNA, 20 bp, mouse
gcgccagcagccaccctgat

SEQ ID NO: 845167 - DNA, 20 bp, mouse
gagggtggctgctggcgaag

SEQ ID NO: 845168 - DNA, 20 bp, mouse
ggaaactagaaatgcggttg

SEQ ID NO: 845169 - DNA, 20 bp, mouse
gcagccaccctgattggcta

SEQ ID NO: 845170 - DNA, 20 bp, mouse
gaggcacaggggtagaactt

SEQ ID NO: 845171 - DNA, 20 bp, mouse
gtgtcaggccttagccaatc

SEQ ID NO: 845172 - DNA, 20 bp, mouse
gttcgggggaaatcaacaaa

SEQ ID NO: 845173 - DNA, 20 bp, mouse
ggaagtggcgcctaagagga

SEQ ID NO: 845174 - DNA, 20 bp, mouse
gtctttctctgtagcttcgg

SEQ ID NO: 845175 - DNA, 20 bp, mouse
ggcgtgctatcgcaagaatc

SEQ ID NO: 845176 - DNA, 20 bp, mouse
gactgcagggacacaaagat

SEQ ID NO: 845177 - DNA, 20 bp, mouse
gtgaggatcttgaatgtcgg

SEQ ID NO: 845178 - DNA, 20 bp, mouse
ggcgcgctgacgctaagagg

SEQ ID NO: 845179 - DNA, 20 bp, mouse
gctggagcatcagtgtccca

SEQ ID NO: 845180 - DNA, 20 bp, mouse
ggagggaagaaggaaatccc

SEQ ID NO: 845181 - DNA, 20 bp, mouse
gaatcgggaactgtaggcag

SEQ ID NO: 845182 - DNA, 20 bp, mouse
ggactgaggatcttgaatgt

SEQ ID NO: 845183 - DNA, 20 bp, mouse
gatgctccaggagggaagac

SEQ ID NO: 845184 - DNA, 20 bp, mouse
gttgtcccacgtggaaacga

SEQ ID NO: 845185 - DNA, 20 bp, mouse
gtaggaagagtgacaagcgg

SEQ ID NO: 845186 - DNA, 20 bp, mouse
gtagccggaatgtggggagg

SEQ ID NO: 845187 - DNA, 20 bp, mouse
ggggcagggtagccggaatg

SEQ ID NO: 845188 - DNA, 20 bp, mouse
gcctccgggcccagtgatgc

SEQ ID NO: 845189 - DNA, 20 bp, mouse
ggggaaccttggagttttga

SEQ ID NO: 845190 - DNA, 20 bp, mouse
gggcgaggaccgggaggcgg

SEQ ID NO: 845191 - DNA, 20 bp, mouse
gaactcaggtccacagcggg

SEQ ID NO: 845192 - DNA, 20 bp, mouse
gcgggcggctgggcgaggac

SEQ ID NO: 845193 - DNA, 20 bp, mouse
ggcttgcctccccagctctc

SEQ ID NO: 845194 - DNA, 20 bp, mouse
gagaaaagttccatcaactc

SEQ ID NO: 845195 - DNA, 20 bp, mouse
gaacttgggcaactctgtcc

SEQ ID NO: 845196 - DNA, 20 bp, mouse
gccggcctctggctccgggg

SEQ ID NO: 845197 - DNA, 20 bp, mouse
ggggggcagtgaggcacagg

SEQ ID NO: 845198 - DNA, 20 bp, mouse
gctctggctccggggaggaa

SEQ ID NO: 845199 - DNA, 20 bp, mouse
gctcactggagcctcggctc

SEQ ID NO: 845200 - DNA, 20 bp, mouse
gcaggcgctgcagaattagc

SEQ ID NO: 845201 - DNA, 20 bp, mouse
ggcgcctggagcctgagccg

SEQ ID NO: 845202 - DNA, 20 bp, mouse
gcggagccagaggccggcag

SEQ ID NO: 845203 - DNA, 20 bp, mouse
gtaccccctcccaaaagcag

SEQ ID NO: 845204 - DNA, 20 bp, mouse
gtaaaccccagcaagtttgt

SEQ ID NO: 845205 - DNA, 20 bp, mouse
gcaggaagcagaaagaggcg

SEQ ID NO: 845206 - DNA, 20 bp, mouse
gataacccggggctccgccg

SEQ ID NO: 845207 - DNA, 20 bp, mouse
ggaaacccaactgtaggagg

SEQ ID NO: 845208 - DNA, 20 bp, mouse
ggccgggagccctcaaactg

SEQ ID NO: 845209 - DNA, 20 bp, mouse
ggccgccccgcccactgctg

SEQ ID NO: 845210 - DNA, 20 bp, mouse
gaggtggaatttataacccg

SEQ ID NO: 845211 - DNA, 20 bp, mouse
gcaaacagaaacccaactgt

SEQ ID NO: 845212 - DNA, 20 bp, mouse
gagccaggggccgcggcggt

SEQ ID NO: 845213 - DNA, 20 bp, mouse
gcgcgctccgggcaacttga

SEQ ID NO: 845214 - DNA, 20 bp, mouse
ggcggggcggcacggagcca

SEQ ID NO: 845215 - DNA, 20 bp, mouse
gggattcgcaagctggacgt

SEQ ID NO: 845216 - DNA, 20 bp, mouse
ggcggggcacacggcagctc

SEQ ID NO: 845217 - DNA, 20 bp, mouse
ggggccccagagagaatgga

SEQ ID NO: 845218 - DNA, 20 bp, mouse
gctcccgtgccacttctcta

SEQ ID NO: 845219 - DNA, 20 bp, mouse
gccccagagagaatggatgg

SEQ ID NO: 845220 - DNA, 20 bp, mouse
gagtaggtgcccaggtccct

SEQ ID NO: 845221 - DNA, 20 bp, mouse
ggggcgagggggcactggat

SEQ ID NO: 845222 - DNA, 20 bp, mouse
ggaagtggcacgggagtcgg

SEQ ID NO: 845223 - DNA, 20 bp, mouse
gggtggggaagtaggtgccc

SEQ ID NO: 845224 - DNA, 20 bp, mouse
gtggtgaaggaagttcctgg

SEQ ID NO: 845225 - DNA, 20 bp, mouse
gaacttccttcaccatataa

SEQ ID NO: 845226 - DNA, 20 bp, mouse
gaggggtggaggcctgatca

SEQ ID NO: 845227 - DNA, 20 bp, mouse
ggggcagagaaggctagggg

SEQ ID NO: 845228 - DNA, 20 bp, mouse
gctaccaggccacgggaagg

SEQ ID NO: 845229 - DNA, 20 bp, mouse
gggaggcctgatcaaggctg

SEQ ID NO: 845230 - DNA, 20 bp, mouse
gagtgggcagagaaggctag

SEQ ID NO: 845231 - DNA, 20 bp, mouse
ggcctggtagattacttctt

SEQ ID NO: 845232 - DNA, 20 bp, mouse
gggcctgatcaaggctgagg

SEQ ID NO: 845233 - DNA, 20 bp, mouse
gaccgaagaagtaatctacc

SEQ ID NO: 845234 - DNA, 20 bp, mouse
gcggtaccagtgggcagaga

SEQ ID NO: 845235 - DNA, 20 bp, mouse
gccccctacccccgcgggtt

SEQ ID NO: 845236 - DNA, 20 bp, mouse
gatgtggaggtggtgaacga

SEQ ID NO: 845237 - DNA, 20 bp, mouse
gagaggaggggcacgggcgc

SEQ ID NO: 845238 - DNA, 20 bp, mouse
gaagagctgttggaaagctg

SEQ ID NO: 845239 - DNA, 20 bp, mouse
gactctcccgaggcccctga

SEQ ID NO: 845240 - DNA, 20 bp, mouse
gccgaactacaccaatgtgg

SEQ ID NO: 845241 - DNA, 20 bp, mouse
gtacccgaactacaccaatg

SEQ ID NO: 845242 - DNA, 20 bp, mouse
gttggtcgaaggagctagat

SEQ ID NO: 845243 - DNA, 20 bp, mouse
gctcttctggtcttggtcga

SEQ ID NO: 845244 - DNA, 20 bp, mouse
gagcgagaggcaagagggac

SEQ ID NO: 845245 - DNA, 20 bp, mouse
ggaggtggtgaacgacggcg

SEQ ID NO: 845246 - DNA, 20 bp, mouse
gcccctcgagccttcctcca

SEQ ID NO: 845247 - DNA, 20 bp, mouse
ggccctggaggaaggctcga

SEQ ID NO: 845248 - DNA, 20 bp, mouse
ggatcgcgggaaggattcat

SEQ ID NO: 845249 - DNA, 20 bp, mouse
gaaagagggcccgagattgg

SEQ ID NO: 845250 - DNA, 20 bp, mouse
ggaagtgctaggcctttcag

SEQ ID NO: 845251 - DNA, 20 bp, mouse
ggccgagcgagccagccaat

SEQ ID NO: 845252 - DNA, 20 bp, mouse
gggctaggatggcagtggga

SEQ ID NO: 845253 - DNA, 20 bp, mouse
gcggcggctaggatggcagt

SEQ ID NO: 845254 - DNA, 20 bp, mouse
gtggggagatccgagagcgg

SEQ ID NO: 845255 - DNA, 20 bp, mouse
gactaggcgcgctggtagga

SEQ ID NO: 845256 - DNA, 20 bp, mouse
ggggctgaaagatgcccagg

SEQ ID NO: 845257 - DNA, 20 bp, mouse
ggacgctcgaccaatcacag

SEQ ID NO: 845258 - DNA, 20 bp, mouse
ggaagcgcgtttgactttca

SEQ ID NO: 845259 - DNA, 20 bp, mouse
gacagggggggtgtgaccag

SEQ ID NO: 845260 - DNA, 20 bp, mouse
ggctcgaccaatcacagggg

SEQ ID NO: 845261 - DNA, 20 bp, mouse
ggcggggctgaaagatgccc

SEQ ID NO: 845262 - DNA, 20 bp, mouse
ggtcacaccccccctgtgat

SEQ ID NO: 845263 - DNA, 20 bp, mouse
gaggagctcgcagctcaact

SEQ ID NO: 845264 - DNA, 20 bp, mouse
gccttgtcaccgggccctaa

SEQ ID NO: 845265 - DNA, 20 bp, mouse
gattggtcgagcgtcgaggt

SEQ ID NO: 845266 - DNA, 20 bp, mouse
ggtcacagtagtgatcccat

SEQ ID NO: 845267 - DNA, 20 bp, mouse
ggtgatcccatgggatgaac

SEQ ID NO: 845268 - DNA, 20 bp, mouse
gactactgtgacgtctttcg

SEQ ID NO: 845269 - DNA, 20 bp, mouse
gaatggaacccctctccccg

SEQ ID NO: 845270 - DNA, 20 bp, mouse
gagaaagtccttattttcta

SEQ ID NO: 845271 - DNA, 20 bp, mouse
gaatgttatagacagggcct

SEQ ID NO: 845272 - DNA, 20 bp, mouse
ggattataatgttatagaca

SEQ ID NO: 845273 - DNA, 20 bp, mouse
gtattttctaaggtactcct

SEQ ID NO: 845274 - DNA, 20 bp, mouse
gttttatagggcttgtgctt

SEQ ID NO: 845275 - DNA, 20 bp, mouse
gttatgttgagtctaatcct

SEQ ID NO: 845276 - DNA, 20 bp, mouse
gaccttccgcagttatcgga

SEQ ID NO: 845277 - DNA, 20 bp, mouse
gagcctcgcggcccgcaggg

SEQ ID NO: 845278 - DNA, 20 bp, mouse
ggtggggattaggatcttga

SEQ ID NO: 845279 - DNA, 20 bp, mouse
gaaggtcatgctgaaagtaa

SEQ ID NO: 845280 - DNA, 20 bp, mouse
ggaagtacccggtaagagcg

SEQ ID NO: 845281 - DNA, 20 bp, mouse
gcagaagcctcgcggcccgc

SEQ ID NO: 845282 - DNA, 20 bp, mouse
gaatactagcgcatagtgct

SEQ ID NO: 845283 - DNA, 20 bp, mouse
gccaacccttccgataactg

SEQ ID NO: 845284 - DNA, 20 bp, mouse
ggaggaggagccggaagtta

SEQ ID NO: 845285 - DNA, 20 bp, mouse
gactatgcgctagtatttct

SEQ ID NO: 845286 - DNA, 20 bp, mouse
ggtacctcggcgcaggtagg

SEQ ID NO: 845287 - DNA, 20 bp, mouse
ggggcggcggggttagccaa

SEQ ID NO: 845288 - DNA, 20 bp, mouse
ggagcccagcgtccccgcat

SEQ ID NO: 845289 - DNA, 20 bp, mouse
gagccggcagctaaactccc

SEQ ID NO: 845290 - DNA, 20 bp, mouse
gcgacgacgcgcacctctag

SEQ ID NO: 845291 - DNA, 20 bp, mouse
gttagccaatggcacggcgg

SEQ ID NO: 845292 - DNA, 20 bp, mouse
gtgcgggcgcggggaacact

SEQ ID NO: 845293 - DNA, 20 bp, mouse
gggctccccggtttccacgt

SEQ ID NO: 845294 - DNA, 20 bp, mouse
gactctgtgctcacgccccc

SEQ ID NO: 845295 - DNA, 20 bp, mouse
gcccgcatcggagagccgag

SEQ ID NO: 845296 - DNA, 20 bp, mouse
ggaaggagcgcgagagagca

SEQ ID NO: 845297 - DNA, 20 bp, mouse
gcgagagagcagggctgaca

SEQ ID NO: 845298 - DNA, 20 bp, mouse
gccagggtcttgcacttcag

SEQ ID NO: 845299 - DNA, 20 bp, mouse
gcacagtggggtcgcagagg

SEQ ID NO: 845300 - DNA, 20 bp, mouse
ggaagtacccaggccaggag

SEQ ID NO: 845301 - DNA, 20 bp, mouse
gttagcagagggagcctggg

SEQ ID NO: 845302 - DNA, 20 bp, mouse
ggctgacaagggaagtaccc

SEQ ID NO: 845303 - DNA, 20 bp, mouse
ggaggcggggactgggccga

SEQ ID NO: 845304 - DNA, 20 bp, mouse
ggtacagctcggttagcaga

SEQ ID NO: 845305 - DNA, 20 bp, mouse
gaaaaagtgcagaaagtggc

SEQ ID NO: 845306 - DNA, 20 bp, mouse
ggggagtggaaattcgaaag

SEQ ID NO: 845307 - DNA, 20 bp, mouse
gcacactcgcctctcatact

SEQ ID NO: 845308 - DNA, 20 bp, mouse
gggcttagtgctgaattagg

SEQ ID NO: 845309 - DNA, 20 bp, mouse
ggcactaagcccagtatgag

SEQ ID NO: 845310 - DNA, 20 bp, mouse
ggcttactgagtgtgtgctt

SEQ ID NO: 845311 - DNA, 20 bp, mouse
gtatcggactctcacccctt

SEQ ID NO: 845312 - DNA, 20 bp, mouse
gtttcccaaaaaaagcaagt

SEQ ID NO: 845313 - DNA, 20 bp, mouse
gctgggcttagtgctgaatt

SEQ ID NO: 845314 - DNA, 20 bp, mouse
gcactcccacttgctttttt

SEQ ID NO: 845315 - DNA, 20 bp, mouse
ggagtccgatagtgtaagct

SEQ ID NO: 845316 - DNA, 20 bp, mouse
gacagctaggaatgctgggc

SEQ ID NO: 845317 - DNA, 20 bp, mouse
ggggctggtaaacaggattt

SEQ ID NO: 845318 - DNA, 20 bp, mouse
ggtcaccacgcccctcctac

SEQ ID NO: 845319 - DNA, 20 bp, mouse
ggagaggctgcaagacatta

SEQ ID NO: 845320 - DNA, 20 bp, mouse
gaattcaattggttattctt

SEQ ID NO: 845321 - DNA, 20 bp, mouse
ggaatgctgggctggtaaac

SEQ ID NO: 845322 - DNA, 20 bp, mouse
gcggaggccgaccaatcttc

SEQ ID NO: 845323 - DNA, 20 bp, mouse
ggaagaatcgccacggggca

SEQ ID NO: 845324 - DNA, 20 bp, mouse
ggcatgacagctaggaatgc

SEQ ID NO: 845325 - DNA, 20 bp, mouse
gcgcagctgccgggcatgat

SEQ ID NO: 845326 - DNA, 20 bp, mouse
gcaacagcggggaggtggtg

SEQ ID NO: 845327 - DNA, 20 bp, mouse
gggagggcgtggctgacggt

SEQ ID NO: 845328 - DNA, 20 bp, mouse
gggagcgcgcaacagcgggg

SEQ ID NO: 845329 - DNA, 20 bp, mouse
gcgcgcgcggacacagaggg

SEQ ID NO: 845330 - DNA, 20 bp, mouse
gagaaagccgctcataagtg

SEQ ID NO: 845331 - DNA, 20 bp, mouse
gagcttgaccagaattgggg

SEQ ID NO: 845332 - DNA, 20 bp, mouse
gcggagcttgaccagaattg

SEQ ID NO: 845333 - DNA, 20 bp, mouse
ggcgtggcgcaagtgaaggg

SEQ ID NO: 845334 - DNA, 20 bp, mouse
ggttgcgtggcgcaagtgaa

SEQ ID NO: 845335 - DNA, 20 bp, mouse
ggaggcggagcgcgcaacag

SEQ ID NO: 845336 - DNA, 20 bp, mouse
gctcccgcgcgcagtgagga

SEQ ID NO: 845337 - DNA, 20 bp, mouse
gagaggggagggaacggcgc

SEQ ID NO: 845338 - DNA, 20 bp, mouse
gggcggggagggaggagacg

SEQ ID NO: 845339 - DNA, 20 bp, mouse
gtctcctgagcccctaggaa

SEQ ID NO: 845340 - DNA, 20 bp, mouse
gggcgcggggaccccagcgg

SEQ ID NO: 845341 - DNA, 20 bp, mouse
gcgcacaccgcggccgcggc

SEQ ID NO: 845342 - DNA, 20 bp, mouse
ggtagagtgtgcaagttgca

SEQ ID NO: 845343 - DNA, 20 bp, mouse
gagggagcgcacagctgctg

SEQ ID NO: 845344 - DNA, 20 bp, mouse
gtgcgcgcggaccctgcggg

SEQ ID NO: 845345 - DNA, 20 bp, mouse
ggtgtgcgcgcggaccctgc

SEQ ID NO: 845346 - DNA, 20 bp, mouse
gggaaagtcccggctcaacg

SEQ ID NO: 845347 - DNA, 20 bp, mouse
gtgccagcggatcattctct

SEQ ID NO: 845348 - DNA, 20 bp, mouse
gacccgaggtagaggagccg

SEQ ID NO: 845349 - DNA, 20 bp, mouse
gggaccgagaggcgaacgac

SEQ ID NO: 845350 - DNA, 20 bp, mouse
ggtcccggctcaacgtggag

SEQ ID NO: 845351 - DNA, 20 bp, mouse
ggctcccgtgacaccgcaag

SEQ ID NO: 845352 - DNA, 20 bp, mouse
ggtgtccgtcccgctgccag

SEQ ID NO: 845353 - DNA, 20 bp, mouse
ggaaaggacgacccagctgt

SEQ ID NO: 845354 - DNA, 20 bp, mouse
gagaggcgaacgacaggcac

SEQ ID NO: 845355 - DNA, 20 bp, mouse
ggtcccgcttgcggtgtcac

SEQ ID NO: 845356 - DNA, 20 bp, mouse
ggccaaaaagtgaaaggggt

SEQ ID NO: 845357 - DNA, 20 bp, mouse
ggccagggccaaaaagtgaa

SEQ ID NO: 845358 - DNA, 20 bp, mouse
gaattgggggggggggagta

SEQ ID NO: 845359 - DNA, 20 bp, mouse
gaagtgaaaggggtgggtag

SEQ ID NO: 845360 - DNA, 20 bp, mouse
gaggggtgggtaggggaatt

SEQ ID NO: 845361 - DNA, 20 bp, mouse
gtccccaggtagggagaaag

SEQ ID NO: 845362 - DNA, 20 bp, mouse
gacccacccctttcactttt

SEQ ID NO: 845363 - DNA, 20 bp, mouse
ggagactgtcaccctgttag

SEQ ID NO: 845364 - DNA, 20 bp, mouse
gagctccccttcagctcctt

SEQ ID NO: 845365 - DNA, 20 bp, mouse
ggtagttagcggaggctcag

SEQ ID NO: 845366 - DNA, 20 bp, mouse
gaaggcgtgtgcttcctctt

SEQ ID NO: 845367 - DNA, 20 bp, mouse
gtaggggcttcagaggtcgt

SEQ ID NO: 845368 - DNA, 20 bp, mouse
gggcagctgcatgtgaggga

SEQ ID NO: 845369 - DNA, 20 bp, mouse
gtcaggagctggtcctgaaa

SEQ ID NO: 845370 - DNA, 20 bp, mouse
gggcgcaatggctgtaaagg

SEQ ID NO: 845371 - DNA, 20 bp, mouse
ggggacgtgaacattggcta

SEQ ID NO: 845372 - DNA, 20 bp, mouse
ggaagcacacgccttcctcc

SEQ ID NO: 845373 - DNA, 20 bp, mouse
gcctgcccctggtagaaacg

SEQ ID NO: 845374 - DNA, 20 bp, mouse
gagggcgcgcggaggtccct

SEQ ID NO: 845375 - DNA, 20 bp, mouse
gcggggcgcaatggctgtaa

SEQ ID NO: 845376 - DNA, 20 bp, mouse
ggaattcatgcacagcgcaa

SEQ ID NO: 845377 - DNA, 20 bp, mouse
gcttactggacttggaattt

SEQ ID NO: 845378 - DNA, 20 bp, mouse
gaccaagtgcaagaacgaca

SEQ ID NO: 845379 - DNA, 20 bp, mouse
gttaagccttgctaatacag

SEQ ID NO: 845380 - DNA, 20 bp, mouse
gctctctctatccctccatt

SEQ ID NO: 845381 - DNA, 20 bp, mouse
gatgaattcagaagatgaat

SEQ ID NO: 845382 - DNA, 20 bp, mouse
gtccgtgtcgttcttgcact

SEQ ID NO: 845383 - DNA, 20 bp, mouse
gggcgactacacggagaagc

SEQ ID NO: 845384 - DNA, 20 bp, mouse
gaacattctgagtggcatca

SEQ ID NO: 845385 - DNA, 20 bp, mouse
gtcctttctcttactggact

SEQ ID NO: 845386 - DNA, 20 bp, mouse
gtactgcaggaacaagtatt

SEQ ID NO: 845387 - DNA, 20 bp, mouse
gtgaccagaaagtgatggga

SEQ ID NO: 845388 - DNA, 20 bp, mouse
ggccatgaccagaaagtgat

SEQ ID NO: 845389 - DNA, 20 bp, mouse
gcctcacaggcacaatgccc

SEQ ID NO: 845390 - DNA, 20 bp, mouse
gaagaaagtacatgtactgc

SEQ ID NO: 845391 - DNA, 20 bp, mouse
ggtacatacctgacagggag

SEQ ID NO: 845392 - DNA, 20 bp, mouse
ggatagagtgctcacctcac

SEQ ID NO: 845393 - DNA, 20 bp, mouse
gtagctacatagtgtcttcg

SEQ ID NO: 845394 - DNA, 20 bp, mouse
gcagattgaggagttaagag

SEQ ID NO: 845395 - DNA, 20 bp, mouse
gtaagatctgctctactata

SEQ ID NO: 845396 - DNA, 20 bp, mouse
gggctaattaacaagtagta

SEQ ID NO: 845397 - DNA, 20 bp, mouse
ggtattttgactaataattc

SEQ ID NO: 845398 - DNA, 20 bp, mouse
gggaaggcatgcagaattgt

SEQ ID NO: 845399 - DNA, 20 bp, mouse
gtcatcaaaagtaaagagat

SEQ ID NO: 845400 - DNA, 20 bp, mouse
gtataatattctatatatac

SEQ ID NO: 845401 - DNA, 20 bp, mouse
gtgactgaaacatgttgatt

SEQ ID NO: 845402 - DNA, 20 bp, mouse
gttgcatataagtcttatag

SEQ ID NO: 845403 - DNA, 20 bp, mouse
gaatatctaaaagagtattt

SEQ ID NO: 845404 - DNA, 20 bp, mouse
gcattttaaattaataagat

SEQ ID NO: 845405 - DNA, 20 bp, mouse
gtatatatacaggagaaaca

SEQ ID NO: 845406 - DNA, 20 bp, mouse
gagagggcatctagaaatat

SEQ ID NO: 845407 - DNA, 20 bp, mouse
gtcctaggggaaatagagtg

SEQ ID NO: 845408 - DNA, 20 bp, mouse
gagaaagtgtgctttctgta

SEQ ID NO: 845409 - DNA, 20 bp, mouse
gaaagcacactttctgtgcc

SEQ ID NO: 845410 - DNA, 20 bp, mouse
gcaaaagtatgtcagtctga

SEQ ID NO: 845411 - DNA, 20 bp, mouse
gttgttcagttggacatata

SEQ ID NO: 845412 - DNA, 20 bp, mouse
gcatcaaaagttaaagatat

SEQ ID NO: 845413 - DNA, 20 bp, mouse
gtttctaagacattagactc

SEQ ID NO: 845414 - DNA, 20 bp, mouse
gaaaagatatccaaaagtac

SEQ ID NO: 845415 - DNA, 20 bp, mouse
gcatggatagttgcaaaaga

SEQ ID NO: 845416 - DNA, 20 bp, mouse
gtagactataatgtacactc

SEQ ID NO: 845417 - DNA, 20 bp, mouse
gaactaatatagaaaataga

SEQ ID NO: 845418 - DNA, 20 bp, mouse
gagacttatgagtagaagca

SEQ ID NO: 845419 - DNA, 20 bp, mouse
gtaaggaaatttatatcaat

SEQ ID NO: 845420 - DNA, 20 bp, mouse
gaggtgttaagtataaaata

SEQ ID NO: 845421 - DNA, 20 bp, mouse
gcttctactcataagtctaa

SEQ ID NO: 845422 - DNA, 20 bp, mouse
gaacaaaatatatggcagtc

SEQ ID NO: 845423 - DNA, 20 bp, mouse
gtacaactgaacaaaatata

SEQ ID NO: 845424 - DNA, 20 bp, mouse
gtatgatagtttatatatac

SEQ ID NO: 845425 - DNA, 20 bp, mouse
gtttttttgagtatcttttg

SEQ ID NO: 845426 - DNA, 20 bp, mouse
gtaggccataatttacatgc

SEQ ID NO: 845427 - DNA, 20 bp, mouse
gtgtaatactctctctataa

SEQ ID NO: 845428 - DNA, 20 bp, mouse
gttttccagcatgtaaatta

SEQ ID NO: 845429 - DNA, 20 bp, mouse
ggaacaaacatatgtcagga

SEQ ID NO: 845430 - DNA, 20 bp, mouse
gctgatttacctgagtctta

SEQ ID NO: 845431 - DNA, 20 bp, mouse
gagctgaacaaacatatgtc

SEQ ID NO: 845432 - DNA, 20 bp, mouse
gtctctataaaggagataca

SEQ ID NO: 845433 - DNA, 20 bp, mouse
gaggtgtaaaatataaaatg

SEQ ID NO: 845434 - DNA, 20 bp, mouse
gtttttaagccataagactc

SEQ ID NO: 845435 - DNA, 20 bp, mouse
gtcaattatgagtcaaaaca

SEQ ID NO: 845436 - DNA, 20 bp, mouse
gaatgtcctgggtcaaacat

SEQ ID NO: 845437 - DNA, 20 bp, mouse
gataaaataatagggcaccg

SEQ ID NO: 845438 - DNA, 20 bp, mouse
gggtcaaacatgggaaaagt

SEQ ID NO: 845439 - DNA, 20 bp, mouse
gtcgtcatttataaatgtcc

SEQ ID NO: 845440 - DNA, 20 bp, mouse
gggaatggagatttgctctg

SEQ ID NO: 845441 - DNA, 20 bp, mouse
gcaagagtgaaatagtaggg

SEQ ID NO: 845442 - DNA, 20 bp, mouse
gtggaatgaagcaacttcct

SEQ ID NO: 845443 - DNA, 20 bp, mouse
gtctgaaggatgtcatgccc

SEQ ID NO: 845444 - DNA, 20 bp, mouse
gtcagattctgtaatttccc

SEQ ID NO: 845445 - DNA, 20 bp, mouse
gtccagtctcataaaataat

SEQ ID NO: 845446 - DNA, 20 bp, mouse
ggatgctggtggcgtgagat

SEQ ID NO: 845447 - DNA, 20 bp, mouse
gcctggacacatgtataaaa

SEQ ID NO: 845448 - DNA, 20 bp, mouse
gggagggaggacacggaagg

SEQ ID NO: 845449 - DNA, 20 bp, mouse
ggggatggctgaaaaactta

SEQ ID NO: 845450 - DNA, 20 bp, mouse
gtagggagggaggacacgga

SEQ ID NO: 845451 - DNA, 20 bp, mouse
gacagtgttgtgaactaact

SEQ ID NO: 845452 - DNA, 20 bp, mouse
gttagtctcaggagctttga

SEQ ID NO: 845453 - DNA, 20 bp, mouse
gatggctgaaaaacttaggg

SEQ ID NO: 845454 - DNA, 20 bp, mouse
gggggcatcacgttttttcc

SEQ ID NO: 845455 - DNA, 20 bp, mouse
gctgaaaaacttagggaggg

SEQ ID NO: 845456 - DNA, 20 bp, mouse
gaatgtcctgggtcaaacat

SEQ ID NO: 845457 - DNA, 20 bp, mouse
gggtcaaacatgggaaaagt

SEQ ID NO: 845458 - DNA, 20 bp, mouse
gtcgtcatttataaatgtcc

SEQ ID NO: 845459 - DNA, 20 bp, mouse
gggaatggagatttgctctg

SEQ ID NO: 845460 - DNA, 20 bp, mouse
gcaagagtgaaatagtaggg

SEQ ID NO: 845461 - DNA, 20 bp, mouse
gtggaatgaagcaacttcct

SEQ ID NO: 845462 - DNA, 20 bp, mouse
gtctgaaggatgtcatgacc

SEQ ID NO: 845463 - DNA, 20 bp, mouse
gtcataaaataatagggcac

SEQ ID NO: 845464 - DNA, 20 bp, mouse
gtcagattctgtaatttccc

SEQ ID NO: 845465 - DNA, 20 bp, mouse
gaagttctgaatttatctcg

SEQ ID NO: 845466 - DNA, 20 bp, mouse
gtgggccatgatgaatattc

SEQ ID NO: 845467 - DNA, 20 bp, mouse
gggttccagaatattcatca

SEQ ID NO: 845468 - DNA, 20 bp, mouse
gtctgtatagctatgaataa

SEQ ID NO: 845469 - DNA, 20 bp, mouse
gaaacttgtgattcattgga

SEQ ID NO: 845470 - DNA, 20 bp, mouse
gttaactcttgtgaaagacc

SEQ ID NO: 845471 - DNA, 20 bp, mouse
gaacaaaatgtgtgttggtg

SEQ ID NO: 845472 - DNA, 20 bp, mouse
gtgaatgccatataaaaatc

SEQ ID NO: 845473 - DNA, 20 bp, mouse
gatggcattcatgtgtttcc

SEQ ID NO: 845474 - DNA, 20 bp, mouse
gtactcattaggactatttt

SEQ ID NO: 845475 - DNA, 20 bp, mouse
gagccattctgtgtgcagaa

SEQ ID NO: 845476 - DNA, 20 bp, mouse
ggaggtttacttcacatatc

SEQ ID NO: 845477 - DNA, 20 bp, mouse
gttccctctcacaaaggtgt

SEQ ID NO: 845478 - DNA, 20 bp, mouse
gaccattgcagggtaggcga

SEQ ID NO: 845479 - DNA, 20 bp, mouse
ggagcaataaagagcaatac

SEQ ID NO: 845480 - DNA, 20 bp, mouse
gactaaacaaagaggtaagt

SEQ ID NO: 845481 - DNA, 20 bp, mouse
gaataggaccattgcagggt

SEQ ID NO: 845482 - DNA, 20 bp, mouse
gtccctcgcctaccctgcaa

SEQ ID NO: 845483 - DNA, 20 bp, mouse
gagaaaaacacgatttgtct

SEQ ID NO: 845484 - DNA, 20 bp, mouse
gctgaaattccctctcacaa

SEQ ID NO: 845485 - DNA, 20 bp, mouse
gatcccaacacctttgtgag

SEQ ID NO: 845486 - DNA, 20 bp, mouse
gaagtagagctgcctttcat

SEQ ID NO: 845487 - DNA, 20 bp, mouse
gactttgtctttcttcatta

SEQ ID NO: 845488 - DNA, 20 bp, mouse
gaaaatgacttcaaatcaat

SEQ ID NO: 845489 - DNA, 20 bp, mouse
ggtcttaagaagagcaaatt

SEQ ID NO: 845490 - DNA, 20 bp, mouse
gagtcattttcccccatgaa

SEQ ID NO: 845491 - DNA, 20 bp, mouse
ggcactggttgctgctccat

SEQ ID NO: 845492 - DNA, 20 bp, mouse
gaataataataatacaaggc

SEQ ID NO: 845493 - DNA, 20 bp, mouse
gtgctgtttcttgactttta

SEQ ID NO: 845494 - DNA, 20 bp, mouse
ggatgcaacactatctctac

SEQ ID NO: 845495 - DNA, 20 bp, mouse
gcaaaaataataataataca

SEQ ID NO: 845496 - DNA, 20 bp, mouse
gatgcagtgttctcaggcaa

SEQ ID NO: 845497 - DNA, 20 bp, mouse
gagactctatgtataaattt

SEQ ID NO: 845498 - DNA, 20 bp, mouse
gtaaatttaggcttatgtat

SEQ ID NO: 845499 - DNA, 20 bp, mouse
gttcatttatgcaattttat

SEQ ID NO: 845500 - DNA, 20 bp, mouse
ggtgtccatgcagtgttctc

SEQ ID NO: 845501 - DNA, 20 bp, mouse
gaggacagcactgtccttcg

SEQ ID NO: 845502 - DNA, 20 bp, mouse
ggacacaatacaggctttaa

SEQ ID NO: 845503 - DNA, 20 bp, mouse
gtgatttcttctagtcagaa

SEQ ID NO: 845504 - DNA, 20 bp, mouse
gtgacattttgacacaatac

SEQ ID NO: 845505 - DNA, 20 bp, mouse
gtttcatatataatcatatg

SEQ ID NO: 845506 - DNA, 20 bp, mouse
gtcttttattcccacaagaa

SEQ ID NO: 845507 - DNA, 20 bp, mouse
ggtactgctgcctttcttgt

SEQ ID NO: 845508 - DNA, 20 bp, mouse
gaaaacatataatacagggc

SEQ ID NO: 845509 - DNA, 20 bp, mouse
gtaaaagactttaaatcaat

SEQ ID NO: 845510 - DNA, 20 bp, mouse
gaatacattattagaacata

SEQ ID NO: 845511 - DNA, 20 bp, mouse
gttttaaaacatataataca

SEQ ID NO: 845512 - DNA, 20 bp, mouse
gtcagtatggtcatgttgat

SEQ ID NO: 845513 - DNA, 20 bp, mouse
gcaggaaagaagtgtcataa

SEQ ID NO: 845514 - DNA, 20 bp, mouse
gaacacagagatccatcatg

SEQ ID NO: 845515 - DNA, 20 bp, mouse
ggcagtactttatctcagta

SEQ ID NO: 845516 - DNA, 20 bp, mouse
gtatgtgtacaggaggtaca

SEQ ID NO: 845517 - DNA, 20 bp, mouse
gactatgaattctgtatgtg

SEQ ID NO: 845518 - DNA, 20 bp, mouse
gcttaacatacaaacagtca

SEQ ID NO: 845519 - DNA, 20 bp, mouse
gaatattgtatgtgtacagg

SEQ ID NO: 845520 - DNA, 20 bp, mouse
gcataaaaatagatgaattg

SEQ ID NO: 845521 - DNA, 20 bp, mouse
gataaaatgttgaagagaca

SEQ ID NO: 845522 - DNA, 20 bp, mouse
gagacatttgctaattaaaa

SEQ ID NO: 845523 - DNA, 20 bp, mouse
gatttgctaattaaaatggt

SEQ ID NO: 845524 - DNA, 20 bp, mouse
gttataagtcataacataga

SEQ ID NO: 845525 - DNA, 20 bp, mouse
gtggaaagcatatacaatgc

SEQ ID NO: 845526 - DNA, 20 bp, mouse
gcaaataaatctaaaaggtg

SEQ ID NO: 845527 - DNA, 20 bp, mouse
gtgtgagttacaggaaatat

SEQ ID NO: 845528 - DNA, 20 bp, mouse
ggctgcatcacacacacata

SEQ ID NO: 845529 - DNA, 20 bp, mouse
ggtcttcaaataaatctaaa

SEQ ID NO: 845530 - DNA, 20 bp, mouse
gttttgctgttgtgagttac

SEQ ID NO: 845531 - DNA, 20 bp, mouse
gaagtagagctgcccttcgt

SEQ ID NO: 845532 - DNA, 20 bp, mouse
gtggaaacactgcatgaaca

SEQ ID NO: 845533 - DNA, 20 bp, mouse
gcccatactgggttaaaatg

SEQ ID NO: 845534 - DNA, 20 bp, mouse
gaagacatttttccccacga

SEQ ID NO: 845535 - DNA, 20 bp, mouse
gcccacattttaacccagta

SEQ ID NO: 845536 - DNA, 20 bp, mouse
gcagttggatgttgtcatat

SEQ ID NO: 845537 - DNA, 20 bp, mouse
gttggatgttgtcatatggg

SEQ ID NO: 845538 - DNA, 20 bp, mouse
gtataaatataatgcagtgg

SEQ ID NO: 845539 - DNA, 20 bp, mouse
ggatgttgtcatatgggtgg

SEQ ID NO: 845540 - DNA, 20 bp, mouse
gctaaatggattattttaga

SEQ ID NO: 845541 - DNA, 20 bp, mouse
gagagatggcacagcaatta

SEQ ID NO: 845542 - DNA, 20 bp, mouse
gtctgtaaatccaattaaag

SEQ ID NO: 845543 - DNA, 20 bp, mouse
gaatccaattaaaggggatg

SEQ ID NO: 845544 - DNA, 20 bp, mouse
gtatacatttgtgttttgta

SEQ ID NO: 845545 - DNA, 20 bp, mouse
gataccacatcccctttaat

SEQ ID NO: 845546 - DNA, 20 bp, mouse
gagtgtcttacaggataatt

SEQ ID NO: 845547 - DNA, 20 bp, mouse
gggaagtataagcctttcct

SEQ ID NO: 845548 - DNA, 20 bp, mouse
gatcacctttctggaaggat

SEQ ID NO: 845549 - DNA, 20 bp, mouse
gcagattactgaacgcgacc

SEQ ID NO: 845550 - DNA, 20 bp, mouse
gaaatcatttgatctgctct

SEQ ID NO: 845551 - DNA, 20 bp, mouse
gtatctttccgtatgcagac

SEQ ID NO: 845552 - DNA, 20 bp, mouse
gtgtggtatcagtgtcttac

SEQ ID NO: 845553 - DNA, 20 bp, mouse
gcatgaaagcacagtgtatc

SEQ ID NO: 845554 - DNA, 20 bp, mouse
gaaaaatagagatttcctca

SEQ ID NO: 845555 - DNA, 20 bp, mouse
gtaatctgcacagcactctg

SEQ ID NO: 845556 - DNA, 20 bp, mouse
gagaaatgcatttttgccac

SEQ ID NO: 845557 - DNA, 20 bp, mouse
gcacctgaagaattatagac

SEQ ID NO: 845558 - DNA, 20 bp, mouse
gatttctataacacaagaaa

SEQ ID NO: 845559 - DNA, 20 bp, mouse
gcagtggtgtcttcttactc

SEQ ID NO: 845560 - DNA, 20 bp, mouse
gcgcctgtgtagaattctcc

SEQ ID NO: 845561 - DNA, 20 bp, mouse
gtgaagaattatagacagga

SEQ ID NO: 845562 - DNA, 20 bp, mouse
gaaaactcaggaacatttcc

SEQ ID NO: 845563 - DNA, 20 bp, mouse
gttcctggagaattctacac

SEQ ID NO: 845564 - DNA, 20 bp, mouse
gttgagtaaccgagatggga

SEQ ID NO: 845565 - DNA, 20 bp, mouse
gcaccactgtattaaaactc

SEQ ID NO: 845566 - DNA, 20 bp, mouse
gagatcttgaatttaaatga

SEQ ID NO: 845567 - DNA, 20 bp, mouse
gagaaatgcagatttgccac

SEQ ID NO: 845568 - DNA, 20 bp, mouse
gattgtttgtagtattttcc

SEQ ID NO: 845569 - DNA, 20 bp, mouse
gctgaagaattatagacaga

SEQ ID NO: 845570 - DNA, 20 bp, mouse
gaaaactcaggaacatttcc

SEQ ID NO: 845571 - DNA, 20 bp, mouse
gttgagtaaccgagatggga

SEQ ID NO: 845572 - DNA, 20 bp, mouse
gcaccactgtattaaaactc

SEQ ID NO: 845573 - DNA, 20 bp, mouse
gttcctggtgaattctacac

SEQ ID NO: 845574 - DNA, 20 bp, mouse
gcagtggtgtcttcttaccc

SEQ ID NO: 845575 - DNA, 20 bp, mouse
gcgcctgtgtagaattcacc

SEQ ID NO: 845576 - DNA, 20 bp, mouse
ggtagagctgcccttcgtgg

SEQ ID NO: 845577 - DNA, 20 bp, mouse
gcacacaccgatccatcata

SEQ ID NO: 845578 - DNA, 20 bp, mouse
ggtctttccttatgatggat

SEQ ID NO: 845579 - DNA, 20 bp, mouse
ggtcttcaaataaattgaaa

SEQ ID NO: 845580 - DNA, 20 bp, mouse
gactttgtctttccttatga

SEQ ID NO: 845581 - DNA, 20 bp, mouse
gtgtgaattacaggaaatac

SEQ ID NO: 845582 - DNA, 20 bp, mouse
gaaagtagagctgcccttcg

SEQ ID NO: 845583 - DNA, 20 bp, mouse
gcccatactgggttaaaatg

SEQ ID NO: 845584 - DNA, 20 bp, mouse
gaagacattttcccccacga

SEQ ID NO: 845585 - DNA, 20 bp, mouse
gcccacattttaacccagta

SEQ ID NO: 845586 - DNA, 20 bp, mouse
gtactgctgcctttttttat

SEQ ID NO: 845587 - DNA, 20 bp, mouse
gaaaacatataatacagggc

SEQ ID NO: 845588 - DNA, 20 bp, mouse
gcttttattcccataaaaaa

SEQ ID NO: 845589 - DNA, 20 bp, mouse
gttttaaaacatataataca

SEQ ID NO: 845590 - DNA, 20 bp, mouse
ggacttcaaatcaattgtaa

SEQ ID NO: 845591 - DNA, 20 bp, mouse
gcaggaaagaagtgtcataa

SEQ ID NO: 845592 - DNA, 20 bp, mouse
gaacacagagatccatcatg

SEQ ID NO: 845593 - DNA, 20 bp, mouse
ggcagtactttatctcagta

SEQ ID NO: 845594 - DNA, 20 bp, mouse
gaatgcaacactatttctgt

SEQ ID NO: 845595 - DNA, 20 bp, mouse
ggaaatacaaatttgttttg

SEQ ID NO: 845596 - DNA, 20 bp, mouse
gagactctatgtataaattt

SEQ ID NO: 845597 - DNA, 20 bp, mouse
gtaaatttaggcttatgtac

SEQ ID NO: 845598 - DNA, 20 bp, mouse
gttcatttatgcaattttat

SEQ ID NO: 845599 - DNA, 20 bp, mouse
gcataataagaggaattcaa

SEQ ID NO: 845600 - DNA, 20 bp, mouse
gatgtccatgcagtgttctc

SEQ ID NO: 845601 - DNA, 20 bp, mouse
gagtttcttctcataataag

SEQ ID NO: 845602 - DNA, 20 bp, mouse
gaggacagcactgtccttcg

SEQ ID NO: 845603 - DNA, 20 bp, mouse
gtttgcctgagaacactgca

SEQ ID NO: 845604 - DNA, 20 bp, mouse
ggacacaatacaggctttaa

SEQ ID NO: 845605 - DNA, 20 bp, mouse
gtgatttcttctagtcagaa

SEQ ID NO: 845606 - DNA, 20 bp, mouse
gaacacagtcgtgaggacat

SEQ ID NO: 845607 - DNA, 20 bp, mouse
gcactgttctattacagtac

SEQ ID NO: 845608 - DNA, 20 bp, mouse
gactcaaaataaaatttgct

SEQ ID NO: 845609 - DNA, 20 bp, mouse
gacaatagaacacagtcgtg

SEQ ID NO: 845610 - DNA, 20 bp, mouse
gacatcttcattggttaagt

SEQ ID NO: 845611 - DNA, 20 bp, mouse
gtcaatataattatgaggga

SEQ ID NO: 845612 - DNA, 20 bp, mouse
gcaatgcaaaattcatctca

SEQ ID NO: 845613 - DNA, 20 bp, mouse
gacatgtttgagcacaccat

SEQ ID NO: 845614 - DNA, 20 bp, mouse
gaaaatttgctgggctgtga

SEQ ID NO: 845615 - DNA, 20 bp, mouse
ggaattcaatataattatga

SEQ ID NO: 845616 - DNA, 20 bp, mouse
gtacaacacagtaaccaaga

SEQ ID NO: 845617 - DNA, 20 bp, mouse
gaccaatgtgaccataaaga

SEQ ID NO: 845618 - DNA, 20 bp, mouse
gcaagctttgcaattgattt

SEQ ID NO: 845619 - DNA, 20 bp, mouse
gagttcatgcattgttctcc

SEQ ID NO: 845620 - DNA, 20 bp, mouse
gaactattctatcacaatac

SEQ ID NO: 845621 - DNA, 20 bp, mouse
gtattgcaactccatcttta

SEQ ID NO: 845622 - DNA, 20 bp, mouse
gttcaaaataatttggaggg

SEQ ID NO: 845623 - DNA, 20 bp, mouse
ggttataaaaattaagttgt

SEQ ID NO: 845624 - DNA, 20 bp, mouse
gaatatgttattgaaacata

SEQ ID NO: 845625 - DNA, 20 bp, mouse
gcaatacaaaatttatcttc

SEQ ID NO: 845626 - DNA, 20 bp, mouse
gggacatattaatgaagaat

SEQ ID NO: 845627 - DNA, 20 bp, mouse
gggatggtttatagaaatat

SEQ ID NO: 845628 - DNA, 20 bp, mouse
gtctcatgcttcttaataga

SEQ ID NO: 845629 - DNA, 20 bp, mouse
gaacatgtagaaagcaaaag

SEQ ID NO: 845630 - DNA, 20 bp, mouse
gatattttggtgaataaaat

SEQ ID NO: 845631 - DNA, 20 bp, mouse
gggtaaaattacagaatatg

SEQ ID NO: 845632 - DNA, 20 bp, mouse
gtgtagaaagcaaaagagga

SEQ ID NO: 845633 - DNA, 20 bp, mouse
gttaactgagatagatattt

SEQ ID NO: 845634 - DNA, 20 bp, mouse
gtgggctatgatatacagtc

SEQ ID NO: 845635 - DNA, 20 bp, mouse
gtctacagatatgtctgtga

SEQ ID NO: 845636 - DNA, 20 bp, mouse
gcactacaatatctcaaggc

SEQ ID NO: 845637 - DNA, 20 bp, mouse
ggagggagggaagactgcaa

SEQ ID NO: 845638 - DNA, 20 bp, mouse
gacactataggagaattgtc

SEQ ID NO: 845639 - DNA, 20 bp, mouse
ggcatcactacaatatctca

SEQ ID NO: 845640 - DNA, 20 bp, mouse
gacattattctatacactat

SEQ ID NO: 845641 - DNA, 20 bp, mouse
ggaattcaatacagttggga

SEQ ID NO: 845642 - DNA, 20 bp, mouse
ggaattcaatatagttagga

SEQ ID NO: 845643 - DNA, 20 bp, mouse
gcatcagaattcaatacagt

SEQ ID NO: 845644 - DNA, 20 bp, mouse
gtcaatacagttgggaggga

SEQ ID NO: 845645 - DNA, 20 bp, mouse
gaaaatgtgtgtcattgtgt

SEQ ID NO: 845646 - DNA, 20 bp, mouse
ggatggaatcacatacaaaa

SEQ ID NO: 845647 - DNA, 20 bp, mouse
gacaccatgggctttgcata

SEQ ID NO: 845648 - DNA, 20 bp, mouse
gcttcacaataacacacatt

SEQ ID NO: 845649 - DNA, 20 bp, mouse
gtttgcatatggataaagag

SEQ ID NO: 845650 - DNA, 20 bp, mouse
gacaaaatttatcttggtgc

SEQ ID NO: 845651 - DNA, 20 bp, mouse
gtgtgattacataatcaata

SEQ ID NO: 845652 - DNA, 20 bp, mouse
gtgcaatacaaaatttatct

SEQ ID NO: 845653 - DNA, 20 bp, mouse
gaacatgttatgataacatg

SEQ ID NO: 845654 - DNA, 20 bp, mouse
gtacatctatatgatcaagt

SEQ ID NO: 845655 - DNA, 20 bp, mouse
gcacacatttggacacacca

SEQ ID NO: 845656 - DNA, 20 bp, mouse
gtttgcctggagaacaatgt

SEQ ID NO: 845657 - DNA, 20 bp, mouse
gtgtccctacattgttctcc

SEQ ID NO: 845658 - DNA, 20 bp, mouse
ggcaggacactgctaccctc

SEQ ID NO: 845659 - DNA, 20 bp, mouse
gctatacaaaatatatctcg

SEQ ID NO: 845660 - DNA, 20 bp, mouse
gaattcaatacaattaggag

SEQ ID NO: 845661 - DNA, 20 bp, mouse
gtgatgccaaaatctgatga

SEQ ID NO: 845662 - DNA, 20 bp, mouse
gtttgattacgaataaagac

SEQ ID NO: 845663 - DNA, 20 bp, mouse
gcaatagaacagactcctga

SEQ ID NO: 845664 - DNA, 20 bp, mouse
gcataattaggagagagaag

SEQ ID NO: 845665 - DNA, 20 bp, mouse
gattgtccatgcttatcaat

SEQ ID NO: 845666 - DNA, 20 bp, mouse
gtcatccccaaaattttgac

SEQ ID NO: 845667 - DNA, 20 bp, mouse
gaatcccacaatagcacata

SEQ ID NO: 845668 - DNA, 20 bp, mouse
gtgtgcaagtgaatgagatc

SEQ ID NO: 845669 - DNA, 20 bp, mouse
gtttccatatgtgctattgt

SEQ ID NO: 845670 - DNA, 20 bp, mouse
gttcaaaatacagtgataat

SEQ ID NO: 845671 - DNA, 20 bp, mouse
gctgaaacaaaaaaatatcc

SEQ ID NO: 845672 - DNA, 20 bp, mouse
gataccaactgattatagct

SEQ ID NO: 845673 - DNA, 20 bp, mouse
gcttttctttggggaaaatc

SEQ ID NO: 845674 - DNA, 20 bp, mouse
gttggataatcttttctttg

SEQ ID NO: 845675 - DNA, 20 bp, mouse
gattcatctaactcgagaaa

SEQ ID NO: 845676 - DNA, 20 bp, mouse
ggggaaaatctggaaagatg

SEQ ID NO: 845677 - DNA, 20 bp, mouse
gttcaaaatacactgatatt

SEQ ID NO: 845678 - DNA, 20 bp, mouse
gccaaataaaagattatcca

SEQ ID NO: 845679 - DNA, 20 bp, mouse
ggcatatattctctagaata

SEQ ID NO: 845680 - DNA, 20 bp, mouse
gtggaaagatgtggaagatc

SEQ ID NO: 845681 - DNA, 20 bp, mouse
gcttttatttggggaaaatc

SEQ ID NO: 845682 - DNA, 20 bp, mouse
gatatatgcgtaaaacaaat

SEQ ID NO: 845683 - DNA, 20 bp, mouse
gggggatgaggcattttatg

SEQ ID NO: 845684 - DNA, 20 bp, mouse
gtacttctgtcaaaattttg

SEQ ID NO: 845685 - DNA, 20 bp, mouse
gattcaggataatgtgatgt

SEQ ID NO: 845686 - DNA, 20 bp, mouse
gccctggaaaggaagtgtca

SEQ ID NO: 845687 - DNA, 20 bp, mouse
gtccctgacacttcctttcc

SEQ ID NO: 845688 - DNA, 20 bp, mouse
gtgcatgcatgaattatcct

SEQ ID NO: 845689 - DNA, 20 bp, mouse
gttgcactctctttgtgggg

SEQ ID NO: 845690 - DNA, 20 bp, mouse
gtctcttgcactctctttgt

SEQ ID NO: 845691 - DNA, 20 bp, mouse
gagaagaagaaatttcattt

SEQ ID NO: 845692 - DNA, 20 bp, mouse
ggctatgatgagagctacca

SEQ ID NO: 845693 - DNA, 20 bp, mouse
gttcaaatctaaagttttaa

SEQ ID NO: 845694 - DNA, 20 bp, mouse
gcaacagtgagttgggtaac

SEQ ID NO: 845695 - DNA, 20 bp, mouse
ggtgtgctccaacagtgagt

SEQ ID NO: 845696 - DNA, 20 bp, mouse
gctatggtgagaggtaaaca

SEQ ID NO: 845697 - DNA, 20 bp, mouse
gaaaataacctagagggtac

SEQ ID NO: 845698 - DNA, 20 bp, mouse
gaccatgagcctcagaattt

SEQ ID NO: 845699 - DNA, 20 bp, mouse
gggaaaaaaaaaaagattca

SEQ ID NO: 845700 - DNA, 20 bp, mouse
gtcctaaattctgaggctca

SEQ ID NO: 845701 - DNA, 20 bp, mouse
gttcaagaatcagataagaa

SEQ ID NO: 845702 - DNA, 20 bp, mouse
gtgaatagtacaacaatttc

SEQ ID NO: 845703 - DNA, 20 bp, mouse
ggcacataaaataacctaga

SEQ ID NO: 845704 - DNA, 20 bp, mouse
gttatgtgcactgacaggcg

SEQ ID NO: 845705 - DNA, 20 bp, mouse
gttgtgattaaattcaacta

SEQ ID NO: 845706 - DNA, 20 bp, mouse
gctgtaacatggaatgttgg

SEQ ID NO: 845707 - DNA, 20 bp, mouse
gtgcctgtaacatggaatgt

SEQ ID NO: 845708 - DNA, 20 bp, mouse
gtcagaaagctttgggatta

SEQ ID NO: 845709 - DNA, 20 bp, mouse
gggtgagaaaattacatgat

SEQ ID NO: 845710 - DNA, 20 bp, mouse
gggctgcagagatggaatag

SEQ ID NO: 845711 - DNA, 20 bp, mouse
gttaactcttgcaaaggata

SEQ ID NO: 845712 - DNA, 20 bp, mouse
gaaaatgcttaatctagtaa

SEQ ID NO: 845713 - DNA, 20 bp, mouse
gattctcagctatgacatga

SEQ ID NO: 845714 - DNA, 20 bp, mouse
ggcttaatctagtaaaggaa

SEQ ID NO: 845715 - DNA, 20 bp, mouse
gagctactgtaaatgtatgt

SEQ ID NO: 845716 - DNA, 20 bp, mouse
gagagtctgtagaacaaagg

SEQ ID NO: 845717 - DNA, 20 bp, mouse
ggagattgaaaaacctaata

SEQ ID NO: 845718 - DNA, 20 bp, mouse
gacgtgtcatgttccatatt

SEQ ID NO: 845719 - DNA, 20 bp, mouse
ggatcaagatgcaaataaga

SEQ ID NO: 845720 - DNA, 20 bp, mouse
gtggaaaggtcttttcatcc

SEQ ID NO: 845721 - DNA, 20 bp, mouse
ggagttaacacagataattc

SEQ ID NO: 845722 - DNA, 20 bp, mouse
gatccaacttccaaagtcta

SEQ ID NO: 845723 - DNA, 20 bp, mouse
gtccagagtctgtagaacaa

SEQ ID NO: 845724 - DNA, 20 bp, mouse
gggtgttcaagaggcagagt

SEQ ID NO: 845725 - DNA, 20 bp, mouse
gaagaaggggccttagactt

SEQ ID NO: 845726 - DNA, 20 bp, mouse
gctcacactgggtgacatga

SEQ ID NO: 845727 - DNA, 20 bp, mouse
gatgtgaacttgaggaacaa

SEQ ID NO: 845728 - DNA, 20 bp, mouse
gggtcaaggggcctgagaag

SEQ ID NO: 845729 - DNA, 20 bp, mouse
gacagtctttgtttttcccg

SEQ ID NO: 845730 - DNA, 20 bp, mouse
gaaggattgtcgtgaaatgc

SEQ ID NO: 845731 - DNA, 20 bp, mouse
gagtgatgatggctaaaatc

SEQ ID NO: 845732 - DNA, 20 bp, mouse
gactgtcttgtgcttcatcc

SEQ ID NO: 845733 - DNA, 20 bp, mouse
gtttcccgtggaagtgatga

SEQ ID NO: 845734 - DNA, 20 bp, mouse
gtagattaatggcctcaaag

SEQ ID NO: 845735 - DNA, 20 bp, mouse
gttgaccataaattatacac

SEQ ID NO: 845736 - DNA, 20 bp, mouse
gaagtcatgatattgaacat

SEQ ID NO: 845737 - DNA, 20 bp, mouse
gaatagatgccttgacctat

SEQ ID NO: 845738 - DNA, 20 bp, mouse
ggataatcagtggggaccta

SEQ ID NO: 845739 - DNA, 20 bp, mouse
gtgtgtaccagattgcaaag

SEQ ID NO: 845740 - DNA, 20 bp, mouse
gtcagtggggacctagggca

SEQ ID NO: 845741 - DNA, 20 bp, mouse
gtcagatcctctttgcaatc

SEQ ID NO: 845742 - DNA, 20 bp, mouse
gacctatagggataatcagt

SEQ ID NO: 845743 - DNA, 20 bp, mouse
gccccactgattatccctat

SEQ ID NO: 845744 - DNA, 20 bp, mouse
gtgattatccctataggtca

SEQ ID NO: 845745 - DNA, 20 bp, mouse
gctgtagaagcaagaatgga

SEQ ID NO: 845746 - DNA, 20 bp, mouse
gacagctatcatcattttaa

SEQ ID NO: 845747 - DNA, 20 bp, mouse
gacaacaaaaaccaagtatc

SEQ ID NO: 845748 - DNA, 20 bp, mouse
gctgagtgacgtgaggggaa

SEQ ID NO: 845749 - DNA, 20 bp, mouse
gtcatactgagtgacgtgag

SEQ ID NO: 845750 - DNA, 20 bp, mouse
gtgggaagatcacagtcaaa

SEQ ID NO: 845751 - DNA, 20 bp, mouse
gcaaatggacgtttgaactg

SEQ ID NO: 845752 - DNA, 20 bp, mouse
ggataaacaattgtcatgaa

SEQ ID NO: 845753 - DNA, 20 bp, mouse
gttctctgttcattcctatg

SEQ ID NO: 845754 - DNA, 20 bp, mouse
gttctgagtatgaacctgag

SEQ ID NO: 845755 - DNA, 20 bp, mouse
gttaaggatgtaaacatata

SEQ ID NO: 845756 - DNA, 20 bp, mouse
gtaagtacatgcattaacat

SEQ ID NO: 845757 - DNA, 20 bp, mouse
gctgggaacttgttcatctt

SEQ ID NO: 845758 - DNA, 20 bp, mouse
gaggaagtgtttgcttggaa

SEQ ID NO: 845759 - DNA, 20 bp, mouse
ggacagggtacattacagag

SEQ ID NO: 845760 - DNA, 20 bp, mouse
gcaaagcaaagaattcaatc

SEQ ID NO: 845761 - DNA, 20 bp, mouse
gcatcttgggctagctgaca

SEQ ID NO: 845762 - DNA, 20 bp, mouse
gtttagagctgagagacata

SEQ ID NO: 845763 - DNA, 20 bp, mouse
gcaggataactcatcctggc

SEQ ID NO: 845764 - DNA, 20 bp, mouse
gaagaataactccaatgcac

SEQ ID NO: 845765 - DNA, 20 bp, mouse
gtgaaatatgaaaatgtaca

SEQ ID NO: 845766 - DNA, 20 bp, mouse
gaggtacaagatgttccata

SEQ ID NO: 845767 - DNA, 20 bp, mouse
gcccacagataccacaggta

SEQ ID NO: 845768 - DNA, 20 bp, mouse
gttgacatatgcaatgaaat

SEQ ID NO: 845769 - DNA, 20 bp, mouse
gacatcttgtaccttacctg

SEQ ID NO: 845770 - DNA, 20 bp, mouse
gggtaggctaagaaaggttc

SEQ ID NO: 845771 - DNA, 20 bp, mouse
gtgctgagatgcaaaataca

SEQ ID NO: 845772 - DNA, 20 bp, mouse
ggcttgagaaattgactgat

SEQ ID NO: 845773 - DNA, 20 bp, mouse
gagaggaggtaggctaagaa

SEQ ID NO: 845774 - DNA, 20 bp, mouse
gcacccttcttcaagttctg

SEQ ID NO: 845775 - DNA, 20 bp, mouse
gtacctcctcttgaacactt

SEQ ID NO: 845776 - DNA, 20 bp, mouse
gctaacatttctggaggata

SEQ ID NO: 845777 - DNA, 20 bp, mouse
ggatgtaagatttacagaat

SEQ ID NO: 845778 - DNA, 20 bp, mouse
gtcaaatcacctaacatttc

SEQ ID NO: 845779 - DNA, 20 bp, mouse
gtatatttgagtctctagat

SEQ ID NO: 845780 - DNA, 20 bp, mouse
gaatcacctaacatttctgg

SEQ ID NO: 845781 - DNA, 20 bp, mouse
gtgctgtagcaatcaaaatg

SEQ ID NO: 845782 - DNA, 20 bp, mouse
gaattggattgcaggataga

SEQ ID NO: 845783 - DNA, 20 bp, mouse
gagaaattatcagtaaatca

SEQ ID NO: 845784 - DNA, 20 bp, mouse
gacgcacagacagattgcca

SEQ ID NO: 845785 - DNA, 20 bp, mouse
gatggcttaattaacaccaa

SEQ ID NO: 845786 - DNA, 20 bp, mouse
ggtagctatcatcacttgaa

SEQ ID NO: 845787 - DNA, 20 bp, mouse
gaagaacttgatggatgtag

SEQ ID NO: 845788 - DNA, 20 bp, mouse
gtgatgtcatgcttacatgt

SEQ ID NO: 845789 - DNA, 20 bp, mouse
gcatgataataagaacttga

SEQ ID NO: 845790 - DNA, 20 bp, mouse
gtaggttagtgactgagcta

SEQ ID NO: 845791 - DNA, 20 bp, mouse
gaactggaccagcttctttg

SEQ ID NO: 845792 - DNA, 20 bp, mouse
gcctttgatcaattaaatat

SEQ ID NO: 845793 - DNA, 20 bp, mouse
gtcatttcccccaaagaagc

SEQ ID NO: 845794 - DNA, 20 bp, mouse
gcagtagcctgaggtcatac

SEQ ID NO: 845795 - DNA, 20 bp, mouse
gtggatgtaggggataaaga

SEQ ID NO: 845796 - DNA, 20 bp, mouse
gagccttgggctttaggaac

SEQ ID NO: 845797 - DNA, 20 bp, mouse
gacccagttcctaaagccca

SEQ ID NO: 845798 - DNA, 20 bp, mouse
gaggttaacctagagcccac

SEQ ID NO: 845799 - DNA, 20 bp, mouse
gaaatacaagatacaaactt

SEQ ID NO: 845800 - DNA, 20 bp, mouse
gtaaaagtgagagatgctgc

SEQ ID NO: 845801 - DNA, 20 bp, mouse
gtcaagatgcagataagaaa

SEQ ID NO: 845802 - DNA, 20 bp, mouse
gaccaaacacttgttagtac

SEQ ID NO: 845803 - DNA, 20 bp, mouse
gcaggttcagcatgagcctt

SEQ ID NO: 845804 - DNA, 20 bp, mouse
ggctgcaggtgtggagcagc

SEQ ID NO: 845805 - DNA, 20 bp, mouse
ggctatgtaaatttttttaa

SEQ ID NO: 845806 - DNA, 20 bp, mouse
gtatacaggagatgcatgca

SEQ ID NO: 845807 - DNA, 20 bp, mouse
gtttcatacttgttgatgat

SEQ ID NO: 845808 - DNA, 20 bp, mouse
gttaacacctaaaacagtag

SEQ ID NO: 845809 - DNA, 20 bp, mouse
gaaatgtattgttcataata

SEQ ID NO: 845810 - DNA, 20 bp, mouse
ggaagataacaaaaaaattg

SEQ ID NO: 845811 - DNA, 20 bp, mouse
gaagtatttgcacaaaatag

SEQ ID NO: 845812 - DNA, 20 bp, mouse
gtaacaaaaaaattgaggtg

SEQ ID NO: 845813 - DNA, 20 bp, mouse
gttttgctaattaaaatagt

SEQ ID NO: 845814 - DNA, 20 bp, mouse
ggcaaggcatgtagaaatgt

SEQ ID NO: 845815 - DNA, 20 bp, mouse
gaataaaacttacattgata

SEQ ID NO: 845816 - DNA, 20 bp, mouse
gacaaagcactcatgggcac

SEQ ID NO: 845817 - DNA, 20 bp, mouse
gacctttggggtatttttaa

SEQ ID NO: 845818 - DNA, 20 bp, mouse
ggagctcacaaagcactcat

SEQ ID NO: 845819 - DNA, 20 bp, mouse
ggccattaaaaataccccaa

SEQ ID NO: 845820 - DNA, 20 bp, mouse
gatggcctgactggcgatgt

SEQ ID NO: 845821 - DNA, 20 bp, mouse
ggttaccaacatcgccagtc

SEQ ID NO: 845822 - DNA, 20 bp, mouse
gctggtacctatgctaccta

SEQ ID NO: 845823 - DNA, 20 bp, mouse
gtcctatttcttgtgacctt

SEQ ID NO: 845824 - DNA, 20 bp, mouse
ggtatttttaatggcctgac

SEQ ID NO: 845825 - DNA, 20 bp, mouse
gtgttctgtgagttatatgg

SEQ ID NO: 845826 - DNA, 20 bp, mouse
gtccatgggaataggaaaaa

SEQ ID NO: 845827 - DNA, 20 bp, mouse
gtcgtcatttccatgggaat

SEQ ID NO: 845828 - DNA, 20 bp, mouse
gtgactgtcgtcatttccat

SEQ ID NO: 845829 - DNA, 20 bp, mouse
gccaatgctcaggactgtcc

SEQ ID NO: 845830 - DNA, 20 bp, mouse
gatgcattaagctttggtct

SEQ ID NO: 845831 - DNA, 20 bp, mouse
gttaatgcatggcaccactt

SEQ ID NO: 845832 - DNA, 20 bp, mouse
gggtgccatgcattaagctt

SEQ ID NO: 845833 - DNA, 20 bp, mouse
ggatgaaggattgttgtgaa

SEQ ID NO: 845834 - DNA, 20 bp, mouse
gctgggtgagatgaagataa

SEQ ID NO: 845835 - DNA, 20 bp, mouse
gaatcatatggctgcatatg

SEQ ID NO: 845836 - DNA, 20 bp, mouse
gaggtcccagaacaaaaatc

SEQ ID NO: 845837 - DNA, 20 bp, mouse
gatcaccatctccaggtcag

SEQ ID NO: 845838 - DNA, 20 bp, mouse
gggttccgctgacctggaga

SEQ ID NO: 845839 - DNA, 20 bp, mouse
gcatcataatcaccatctcc

SEQ ID NO: 845840 - DNA, 20 bp, mouse
gttcactatggaaaacccac

SEQ ID NO: 845841 - DNA, 20 bp, mouse
gagacaatgcataaatttca

SEQ ID NO: 845842 - DNA, 20 bp, mouse
ggatgcctgatttttgttct

SEQ ID NO: 845843 - DNA, 20 bp, mouse
gtgtgaagagaatctgtgaa

SEQ ID NO: 845844 - DNA, 20 bp, mouse
gcaaatgtggttcctttcca

SEQ ID NO: 845845 - DNA, 20 bp, mouse
ggttcttggttccgctgacc

SEQ ID NO: 845846 - DNA, 20 bp, mouse
gcccacgtctacaattgaag

SEQ ID NO: 845847 - DNA, 20 bp, mouse
gccttgaagccacaggaaga

SEQ ID NO: 845848 - DNA, 20 bp, mouse
gaggaagaaggacaagtttc

SEQ ID NO: 845849 - DNA, 20 bp, mouse
gacaaatactgttgcagatt

SEQ ID NO: 845850 - DNA, 20 bp, mouse
gtattttgagtgctcagaca

SEQ ID NO: 845851 - DNA, 20 bp, mouse
gaaaatatccttgaagccac

SEQ ID NO: 845852 - DNA, 20 bp, mouse
gagaaagggataacaaacag

SEQ ID NO: 845853 - DNA, 20 bp, mouse
gtcaattgtagacgtgggtc

SEQ ID NO: 845854 - DNA, 20 bp, mouse
ggagaaacaggaagaatttt

SEQ ID NO: 845855 - DNA, 20 bp, mouse
gacctcttcaattgtagacg

SEQ ID NO: 845856 - DNA, 20 bp, mouse
gactgcaatgagggtttaag

SEQ ID NO: 845857 - DNA, 20 bp, mouse
ggtgtaccagactgcaatga

SEQ ID NO: 845858 - DNA, 20 bp, mouse
gaatgagggtttaagaggag

SEQ ID NO: 845859 - DNA, 20 bp, mouse
gcttgcttctacagacctgg

SEQ ID NO: 845860 - DNA, 20 bp, mouse
gggcatgtattctagaaact

SEQ ID NO: 845861 - DNA, 20 bp, mouse
gtgtcaacatcatcacctcc

SEQ ID NO: 845862 - DNA, 20 bp, mouse
gaaggtccaagaacaagatc

SEQ ID NO: 845863 - DNA, 20 bp, mouse
gctgtagaagcaagaataga

SEQ ID NO: 845864 - DNA, 20 bp, mouse
gttctgtggaggcatcagca

SEQ ID NO: 845865 - DNA, 20 bp, mouse
gaaagaactaccttctgtgg

SEQ ID NO: 845866 - DNA, 20 bp, mouse
ggacaggataatttggtagc

SEQ ID NO: 845867 - DNA, 20 bp, mouse
ggtacgcagacaggataatt

SEQ ID NO: 845868 - DNA, 20 bp, mouse
gatattttgagtacgcagac

SEQ ID NO: 845869 - DNA, 20 bp, mouse
gttggaattcagttcaatta

SEQ ID NO: 845870 - DNA, 20 bp, mouse
ggtctacatgtgagtgggaa

SEQ ID NO: 845871 - DNA, 20 bp, mouse
ggaggaagaatttttggtag

SEQ ID NO: 845872 - DNA, 20 bp, mouse
gtgtctttcctgcggtctct

SEQ ID NO: 845873 - DNA, 20 bp, mouse
gggatgtgtctacatgtgag

SEQ ID NO: 845874 - DNA, 20 bp, mouse
gaagaaagatggataagcag

SEQ ID NO: 845875 - DNA, 20 bp, mouse
gtgtgtctacatgtgatgtg

SEQ ID NO: 845876 - DNA, 20 bp, mouse
gcacacgcaaaatatctcag

SEQ ID NO: 845877 - DNA, 20 bp, mouse
gtaatgtctcctgtatcctg

SEQ ID NO: 845878 - DNA, 20 bp, mouse
gggatacaggagacattaca

SEQ ID NO: 845879 - DNA, 20 bp, mouse
gtctacatatgatgtgggga

SEQ ID NO: 845880 - DNA, 20 bp, mouse
gagaagctgggaaaccctgc

SEQ ID NO: 845881 - DNA, 20 bp, mouse
gctcagaggccacaggatac

SEQ ID NO: 845882 - DNA, 20 bp, mouse
gtattcaaagcaaaatttaa

SEQ ID NO: 845883 - DNA, 20 bp, mouse
gccagcttctacatatgatg

SEQ ID NO: 845884 - DNA, 20 bp, mouse
gtctgcaggtgttgacctgc

SEQ ID NO: 845885 - DNA, 20 bp, mouse
gaaaatatctcagaggccac

SEQ ID NO: 845886 - DNA, 20 bp, mouse
ggataaagaattttgggtaa

SEQ ID NO: 845887 - DNA, 20 bp, mouse
gattttgggtaatggaaact

SEQ ID NO: 845888 - DNA, 20 bp, mouse
gacaggtaatgttgcagttt

SEQ ID NO: 845889 - DNA, 20 bp, mouse
gttgctgcaattgtagactt

SEQ ID NO: 845890 - DNA, 20 bp, mouse
gcctagagaccacaggaaga

SEQ ID NO: 845891 - DNA, 20 bp, mouse
gtgtgcagagaggagagttt

SEQ ID NO: 845892 - DNA, 20 bp, mouse
ggagaggagagtttgggagc

SEQ ID NO: 845893 - DNA, 20 bp, mouse
gttctggagtcaacaaagca

SEQ ID NO: 845894 - DNA, 20 bp, mouse
gatattttgagtgtgcagag

SEQ ID NO: 845895 - DNA, 20 bp, mouse
ggcaattgtagacttgggtc

SEQ ID NO: 845896 - DNA, 20 bp, mouse
gtctacatatagtgtgggga

SEQ ID NO: 845897 - DNA, 20 bp, mouse
gccagcttctacatatagtg

SEQ ID NO: 845898 - DNA, 20 bp, mouse
gtcctgtttactgtagcctc

SEQ ID NO: 845899 - DNA, 20 bp, mouse
ggctgcaggtgctgatctgc

SEQ ID NO: 845900 - DNA, 20 bp, mouse
gttcaaaactgtatgcatcc

SEQ ID NO: 845901 - DNA, 20 bp, mouse
gcacacacaaaatacaccag

SEQ ID NO: 845902 - DNA, 20 bp, mouse
gagtgtggggaaggcagaca

SEQ ID NO: 845903 - DNA, 20 bp, mouse
gaccagaggctacagtaaac

SEQ ID NO: 845904 - DNA, 20 bp, mouse
ggtattttgtgtgtgttgac

SEQ ID NO: 845905 - DNA, 20 bp, mouse
ggtaaacaggagaaatttca

SEQ ID NO: 845906 - DNA, 20 bp, mouse
gttctgtatagaagttactg

SEQ ID NO: 845907 - DNA, 20 bp, mouse
gattctgtgctcatcgttac

SEQ ID NO: 845908 - DNA, 20 bp, mouse
ggtctgggaaaaaccacaaa

SEQ ID NO: 845909 - DNA, 20 bp, mouse
gaatggttttctaaggcaag

SEQ ID NO: 845910 - DNA, 20 bp, mouse
gtgctcatcgttactggatc

SEQ ID NO: 845911 - DNA, 20 bp, mouse
gaacaaaaatcatatcagtc

SEQ ID NO: 845912 - DNA, 20 bp, mouse
gacaatttaaattataggaa

SEQ ID NO: 845913 - DNA, 20 bp, mouse
gtattaacttgtatttctaa

SEQ ID NO: 845914 - DNA, 20 bp, mouse
gttataggaatggttttcta

SEQ ID NO: 845915 - DNA, 20 bp, mouse
gagaggctcaaatgcaatac

SEQ ID NO: 845916 - DNA, 20 bp, mouse
gctgctgcagttctagacat

SEQ ID NO: 845917 - DNA, 20 bp, mouse
gcttagagactgtaagaagg

SEQ ID NO: 845918 - DNA, 20 bp, mouse
ggaaaggggagtttggtagc

SEQ ID NO: 845919 - DNA, 20 bp, mouse
gacatgtaatgttgcaggtt

SEQ ID NO: 845920 - DNA, 20 bp, mouse
gatagtttgagtgtgcagaa

SEQ ID NO: 845921 - DNA, 20 bp, mouse
gtcaaaaagtggatacatcc

SEQ ID NO: 845922 - DNA, 20 bp, mouse
ggcagttctagacatgggtc

SEQ ID NO: 845923 - DNA, 20 bp, mouse
gactatggtgagtgacaaca

SEQ ID NO: 845924 - DNA, 20 bp, mouse
gctcgggataaattcaacta

SEQ ID NO: 845925 - DNA, 20 bp, mouse
gagcagattccttcaaaaag

SEQ ID NO: 845926 - DNA, 20 bp, mouse
gtgccgcagaagaaagttca

SEQ ID NO: 845927 - DNA, 20 bp, mouse
gaatacatgatttacagaat

SEQ ID NO: 845928 - DNA, 20 bp, mouse
ggtaagataaatatagagct

SEQ ID NO: 845929 - DNA, 20 bp, mouse
gtgcagccacgctgtgaaag

SEQ ID NO: 845930 - DNA, 20 bp, mouse
gtgtatatgccatgtggtac

SEQ ID NO: 845931 - DNA, 20 bp, mouse
gaaatactggttggagtcat

SEQ ID NO: 845932 - DNA, 20 bp, mouse
gaaagtcataatgatatact

SEQ ID NO: 845933 - DNA, 20 bp, mouse
gtgcttagagaaatactggt

SEQ ID NO: 845934 - DNA, 20 bp, mouse
ggatgcttgtatatgccatg

SEQ ID NO: 845935 - DNA, 20 bp, mouse
gatttacagaatgggattac

SEQ ID NO: 845936 - DNA, 20 bp, mouse
gttcttcagactctgggtta

SEQ ID NO: 845937 - DNA, 20 bp, mouse
gaggactttaagaattggaa

SEQ ID NO: 845938 - DNA, 20 bp, mouse
gtcattttctgctgttcgag

SEQ ID NO: 845939 - DNA, 20 bp, mouse
ggagttaacatggataattc

SEQ ID NO: 845940 - DNA, 20 bp, mouse
gtgctagatagacatcgatc

SEQ ID NO: 845941 - DNA, 20 bp, mouse
gaaaaaaggggaagattcag

SEQ ID NO: 845942 - DNA, 20 bp, mouse
gcagagtctgaagaaaaaag

SEQ ID NO: 845943 - DNA, 20 bp, mouse
gataaaaatattaaaacttt

SEQ ID NO: 845944 - DNA, 20 bp, mouse
gataaaacagaataagaaat

SEQ ID NO: 845945 - DNA, 20 bp, mouse
gaagaaataggaagaaattt

SEQ ID NO: 845946 - DNA, 20 bp, mouse
ggtgaggttgttatgctcta

SEQ ID NO: 845947 - DNA, 20 bp, mouse
gtgttatgctctaggggaaa

SEQ ID NO: 845948 - DNA, 20 bp, mouse
gtgttattctaagtgatttg

SEQ ID NO: 845949 - DNA, 20 bp, mouse
gagcataacaacctcacacc

SEQ ID NO: 845950 - DNA, 20 bp, mouse
gaactccctaattacaacta

SEQ ID NO: 845951 - DNA, 20 bp, mouse
gtaggaagaagatcaggctg

SEQ ID NO: 845952 - DNA, 20 bp, mouse
ggatagagctgaatttgtct

SEQ ID NO: 845953 - DNA, 20 bp, mouse
gccaagccatagttgtaatt

SEQ ID NO: 845954 - DNA, 20 bp, mouse
ggagtctttacacaaaccag

SEQ ID NO: 845955 - DNA, 20 bp, mouse
gataaagactagcaggaact

SEQ ID NO: 845956 - DNA, 20 bp, mouse
ggaggtaatcagttcaattg

SEQ ID NO: 845957 - DNA, 20 bp, mouse
gaagagacagcatctgtcct

SEQ ID NO: 845958 - DNA, 20 bp, mouse
gtaaacaagcttttagaagg

SEQ ID NO: 845959 - DNA, 20 bp, mouse
ggacatgagcactagcagtt

SEQ ID NO: 845960 - DNA, 20 bp, mouse
ggagagagagaaatcattta

SEQ ID NO: 845961 - DNA, 20 bp, mouse
gtgttaaacaagcttttaga

SEQ ID NO: 845962 - DNA, 20 bp, mouse
gctaaaggtcactgcttttc

SEQ ID NO: 845963 - DNA, 20 bp, mouse
gacaggggagggcactgagc

SEQ ID NO: 845964 - DNA, 20 bp, mouse
ggcacacatgtaatgcaaac

SEQ ID NO: 845965 - DNA, 20 bp, mouse
ggttatgaaagatatcctaa

SEQ ID NO: 845966 - DNA, 20 bp, mouse
gcaagtgctcaagtctgtgt

SEQ ID NO: 845967 - DNA, 20 bp, mouse
ggtcacactgggtgacataa

SEQ ID NO: 845968 - DNA, 20 bp, mouse
gtgattgggaggaaactatc

SEQ ID NO: 845969 - DNA, 20 bp, mouse
gaaagatcattgtgattggg

SEQ ID NO: 845970 - DNA, 20 bp, mouse
gtgggacatagaaggggatc

SEQ ID NO: 845971 - DNA, 20 bp, mouse
gttgaaagatcattgtgatt

SEQ ID NO: 845972 - DNA, 20 bp, mouse
gcatgcatgaagcctttgtc

SEQ ID NO: 845973 - DNA, 20 bp, mouse
gtgcatatgggacatagaag

SEQ ID NO: 845974 - DNA, 20 bp, mouse
gctgggtgacataagggaaa

SEQ ID NO: 845975 - DNA, 20 bp, mouse
gatgatgatgactgcaatca

SEQ ID NO: 845976 - DNA, 20 bp, mouse
gaggcgatgcataagtatca

SEQ ID NO: 845977 - DNA, 20 bp, mouse
gttaagggacaagtctctac

SEQ ID NO: 845978 - DNA, 20 bp, mouse
gaggtctgcaaagaggatct

SEQ ID NO: 845979 - DNA, 20 bp, mouse
gtctctacaggtctgcaaag

SEQ ID NO: 845980 - DNA, 20 bp, mouse
ggtgttctgtgaaggctgag

SEQ ID NO: 845981 - DNA, 20 bp, mouse
gagtgcaatgtgctacttaa

SEQ ID NO: 845982 - DNA, 20 bp, mouse
gggcaagtattgccattctt

SEQ ID NO: 845983 - DNA, 20 bp, mouse
gaaggtccaagagcaaaatt

SEQ ID NO: 845984 - DNA, 20 bp, mouse
gctatgggaaattcgaacaa

SEQ ID NO: 845985 - DNA, 20 bp, mouse
gcctggaaagcaaccctaat

SEQ ID NO: 845986 - DNA, 20 bp, mouse
gagggaaaggaggagtttca

SEQ ID NO: 845987 - DNA, 20 bp, mouse
ggagctctgggaattgcata

SEQ ID NO: 845988 - DNA, 20 bp, mouse
gtagcagttgattttagtga

SEQ ID NO: 845989 - DNA, 20 bp, mouse
gttacaggtgttgatcagca

SEQ ID NO: 845990 - DNA, 20 bp, mouse
gcagggtcagcatgagctct

SEQ ID NO: 845991 - DNA, 20 bp, mouse
gtttggatggggaaatttgg

SEQ ID NO: 845992 - DNA, 20 bp, mouse
gggactcagggatgctgtgt

SEQ ID NO: 845993 - DNA, 20 bp, mouse
gtcctttccctgtggactca

SEQ ID NO: 845994 - DNA, 20 bp, mouse
ggtttttcagatccatgtct

SEQ ID NO: 845995 - DNA, 20 bp, mouse
gcagcatccctgagtccaca

SEQ ID NO: 845996 - DNA, 20 bp, mouse
gagagtggtcatatgacctg

SEQ ID NO: 845997 - DNA, 20 bp, mouse
gtagccatcatcattactat

SEQ ID NO: 845998 - DNA, 20 bp, mouse
ggccccatgcaaccatatga

SEQ ID NO: 845999 - DNA, 20 bp, mouse
gaaccatcatatggttgcat

SEQ ID NO: 846000 - DNA, 20 bp, mouse
gatcatcattactattggaa

SEQ ID NO: 846001 - DNA, 20 bp, mouse
gttaatatatgacatcactt

SEQ ID NO: 846002 - DNA, 20 bp, mouse
gcatatattaagcttttgtc

SEQ ID NO: 846003 - DNA, 20 bp, mouse
gggttattctgatgaaagaa

SEQ ID NO: 846004 - DNA, 20 bp, mouse
gatgcacataatactttatc

SEQ ID NO: 846005 - DNA, 20 bp, mouse
gccagtgctcaggactatat

SEQ ID NO: 846006 - DNA, 20 bp, mouse
gatgctgtgtgtgctctgac

SEQ ID NO: 846007 - DNA, 20 bp, mouse
ggtgctctgacaggtgagtt

SEQ ID NO: 846008 - DNA, 20 bp, mouse
gtgacaggtgagtttggtga

SEQ ID NO: 846009 - DNA, 20 bp, mouse
gttttattatgaagcagcca

SEQ ID NO: 846010 - DNA, 20 bp, mouse
gtgcaaacacattttcaaga

SEQ ID NO: 846011 - DNA, 20 bp, mouse
gcaggttcagcgtgagcctc

SEQ ID NO: 846012 - DNA, 20 bp, mouse
gagggaaaggaggagcttct

SEQ ID NO: 846013 - DNA, 20 bp, mouse
gacagcatcccagagttcac

SEQ ID NO: 846014 - DNA, 20 bp, mouse
gtgatgtggggagggagaac

SEQ ID NO: 846015 - DNA, 20 bp, mouse
gtcctttccctgtgaactct

SEQ ID NO: 846016 - DNA, 20 bp, mouse
gtgagactcaggtgaaatgc

SEQ ID NO: 846017 - DNA, 20 bp, mouse
gaacaaaaactatggtgacc

SEQ ID NO: 846018 - DNA, 20 bp, mouse
gatttacgcaagaatttttt

SEQ ID NO: 846019 - DNA, 20 bp, mouse
gattatatagtaatactgtg

SEQ ID NO: 846020 - DNA, 20 bp, mouse
gtgtaatattctctatatat

SEQ ID NO: 846021 - DNA, 20 bp, mouse
gaaatcacagttacaattca

SEQ ID NO: 846022 - DNA, 20 bp, mouse
gtcttttatgattttactcc

SEQ ID NO: 846023 - DNA, 20 bp, mouse
ggtattctcatctgattgtt

SEQ ID NO: 846024 - DNA, 20 bp, mouse
gggagggtatataacaatgt

SEQ ID NO: 846025 - DNA, 20 bp, mouse
gcaaaaatgaacaaaaacta

SEQ ID NO: 846026 - DNA, 20 bp, mouse
gatgctgtgtgtgctctagc

SEQ ID NO: 846027 - DNA, 20 bp, mouse
ggtgctctagcaggtgagtt

SEQ ID NO: 846028 - DNA, 20 bp, mouse
gcgggctttgggaattgagt

SEQ ID NO: 846029 - DNA, 20 bp, mouse
gcaggttcagcgtgagcctc

SEQ ID NO: 846030 - DNA, 20 bp, mouse
gagggaaaggaggagcttct

SEQ ID NO: 846031 - DNA, 20 bp, mouse
gaggatgcaaattttttttc

SEQ ID NO: 846032 - DNA, 20 bp, mouse
gtgatgtggggaaggagaac

SEQ ID NO: 846033 - DNA, 20 bp, mouse
gtttgcataatagcattttg

SEQ ID NO: 846034 - DNA, 20 bp, mouse
gcagcgtgagcctcgggctt

SEQ ID NO: 846035 - DNA, 20 bp, mouse
gcagcatcccagagtccaca

SEQ ID NO: 846036 - DNA, 20 bp, mouse
gagaagaagaaatctcactt

SEQ ID NO: 846037 - DNA, 20 bp, mouse
gttaccaaactcactgttgg

SEQ ID NO: 846038 - DNA, 20 bp, mouse
gaactggtattcaaatctac

SEQ ID NO: 846039 - DNA, 20 bp, mouse
gtccctgacactcccgttcc

SEQ ID NO: 846040 - DNA, 20 bp, mouse
gttccccacccaattcccaa

SEQ ID NO: 846041 - DNA, 20 bp, mouse
gagctatgatgagagatacc

SEQ ID NO: 846042 - DNA, 20 bp, mouse
gttcaaatctacaggtttaa

SEQ ID NO: 846043 - DNA, 20 bp, mouse
gttctgtctgtctgcatgca

SEQ ID NO: 846044 - DNA, 20 bp, mouse
gctgcatgcatggattgtcc

SEQ ID NO: 846045 - DNA, 20 bp, mouse
gtgcacctgcagcatctctc

SEQ ID NO: 846046 - DNA, 20 bp, mouse
gaaatcccagctctcagctt

SEQ ID NO: 846047 - DNA, 20 bp, mouse
gtcctaagaaccttcttcca

SEQ ID NO: 846048 - DNA, 20 bp, mouse
gaatgcctaagctgagagct

SEQ ID NO: 846049 - DNA, 20 bp, mouse
gtccttggaagaaggttctt

SEQ ID NO: 846050 - DNA, 20 bp, mouse
gttgatgtttccttggaaga

SEQ ID NO: 846051 - DNA, 20 bp, mouse
gctgggatttgatgtttcct

SEQ ID NO: 846052 - DNA, 20 bp, mouse
gccatatcctcttcttgagt

SEQ ID NO: 846053 - DNA, 20 bp, mouse
gcctgggaagcaacccattg

SEQ ID NO: 846054 - DNA, 20 bp, mouse
gaggatgagtgtatacggga

SEQ ID NO: 846055 - DNA, 20 bp, mouse
gagtctaatccttgccacaa

SEQ ID NO: 846056 - DNA, 20 bp, mouse
gagttcaagtcaataaccca

SEQ ID NO: 846057 - DNA, 20 bp, mouse
gtactgatatttctattcga

SEQ ID NO: 846058 - DNA, 20 bp, mouse
gtgttgcaaaatcacttcct

SEQ ID NO: 846059 - DNA, 20 bp, mouse
gggttattgacttgaactct

SEQ ID NO: 846060 - DNA, 20 bp, mouse
gtggtcattcattctctaac

SEQ ID NO: 846061 - DNA, 20 bp, mouse
gacttgaactcttggagacc

SEQ ID NO: 846062 - DNA, 20 bp, mouse
ggagtcagaattctccgttt

SEQ ID NO: 846063 - DNA, 20 bp, mouse
gacattgcaatctagagccc

SEQ ID NO: 846064 - DNA, 20 bp, mouse
gttttttcacatcaacaacc

SEQ ID NO: 846065 - DNA, 20 bp, mouse
gtttcaatataagttgtaac

SEQ ID NO: 846066 - DNA, 20 bp, mouse
gtccccacttggagaaccaa

SEQ ID NO: 846067 - DNA, 20 bp, mouse
ggctcaaatttgtaaagtca

SEQ ID NO: 846068 - DNA, 20 bp, mouse
gaaatcttcaatacatgcct

SEQ ID NO: 846069 - DNA, 20 bp, mouse
gtagccattggttctccaag

SEQ ID NO: 846070 - DNA, 20 bp, mouse
gaattattgaagcttataaa

SEQ ID NO: 846071 - DNA, 20 bp, mouse
gaagggaatacctccccact

SEQ ID NO: 846072 - DNA, 20 bp, mouse
ggcatgtattgaagatttct

SEQ ID NO: 846073 - DNA, 20 bp, mouse
gtatatgttttacaacagag

SEQ ID NO: 846074 - DNA, 20 bp, mouse
gctttgaatttactagccat

SEQ ID NO: 846075 - DNA, 20 bp, mouse
gaaaagttatcataaataaa

SEQ ID NO: 846076 - DNA, 20 bp, mouse
gtagacgtcaaatttttcac

SEQ ID NO: 846077 - DNA, 20 bp, mouse
gactgactagtgaattcaaa

SEQ ID NO: 846078 - DNA, 20 bp, mouse
gtttcactggaaactattaa

SEQ ID NO: 846079 - DNA, 20 bp, mouse
gactagtcagtgtttcccac

SEQ ID NO: 846080 - DNA, 20 bp, mouse
gcttcttatactctacaaaa

SEQ ID NO: 846081 - DNA, 20 bp, mouse
gataatggtgttccatccag

SEQ ID NO: 846082 - DNA, 20 bp, mouse
gtttatggcttcagtatcac

SEQ ID NO: 846083 - DNA, 20 bp, mouse
gtatattgaagtttcttgat

SEQ ID NO: 846084 - DNA, 20 bp, mouse
gtatgtagttttttacatca

SEQ ID NO: 846085 - DNA, 20 bp, mouse
gatgttagcaataagaataa

SEQ ID NO: 846086 - DNA, 20 bp, mouse
gtatgcttgagtcaagttgt

SEQ ID NO: 846087 - DNA, 20 bp, mouse
ggcagctcttattaaggatt

SEQ ID NO: 846088 - DNA, 20 bp, mouse
ggcttgagtcaagttgtagg

SEQ ID NO: 846089 - DNA, 20 bp, mouse
gatagcttcagtgtcacatg

SEQ ID NO: 846090 - DNA, 20 bp, mouse
gggaaagagttcaccacaca

SEQ ID NO: 846091 - DNA, 20 bp, mouse
gctgctgtgtataaaacata

SEQ ID NO: 846092 - DNA, 20 bp, mouse
gacagcaaaattaccttgtg

SEQ ID NO: 846093 - DNA, 20 bp, mouse
ggagatagcagctcttatta

SEQ ID NO: 846094 - DNA, 20 bp, mouse
gcttgactcaagcatacata

SEQ ID NO: 846095 - DNA, 20 bp, mouse
gttgaaatgatgattaaaca

SEQ ID NO: 846096 - DNA, 20 bp, mouse
gcttgctatgttgtacacaa

SEQ ID NO: 846097 - DNA, 20 bp, mouse
gtggttaaatggtgttcaag

SEQ ID NO: 846098 - DNA, 20 bp, mouse
gactggagtttctatatcca

SEQ ID NO: 846099 - DNA, 20 bp, mouse
ggaaaagtttgaaatttatt

SEQ ID NO: 846100 - DNA, 20 bp, mouse
ggtgggtctacaagaatcac

SEQ ID NO: 846101 - DNA, 20 bp, mouse
gtccaccttgtgagaatcaa

SEQ ID NO: 846102 - DNA, 20 bp, mouse
gaccaaaaatcaacattgaa

SEQ ID NO: 846103 - DNA, 20 bp, mouse
gagaaaatgattattataag

SEQ ID NO: 846104 - DNA, 20 bp, mouse
gtttatggcttcagtacatt

SEQ ID NO: 846105 - DNA, 20 bp, mouse
ggaagttccactacacttca

SEQ ID NO: 846106 - DNA, 20 bp, mouse
gagactcaggtgaaatagag

SEQ ID NO: 846107 - DNA, 20 bp, mouse
gcaaaaactatggttatctg

SEQ ID NO: 846108 - DNA, 20 bp, mouse
gcacataatgtattctcatc

SEQ ID NO: 846109 - DNA, 20 bp, mouse
gtttaaaagttatgagactc

SEQ ID NO: 846110 - DNA, 20 bp, mouse
gtaattctatttctttatat

SEQ ID NO: 846111 - DNA, 20 bp, mouse
gatttatgaaagaattttta

SEQ ID NO: 846112 - DNA, 20 bp, mouse
gagaattgtgagtcaaatta

SEQ ID NO: 846113 - DNA, 20 bp, mouse
ggtattctcatctggttgtt

SEQ ID NO: 846114 - DNA, 20 bp, mouse
gggagggtatataacaatgt

SEQ ID NO: 846115 - DNA, 20 bp, mouse
gtctctgtataggagatact

SEQ ID NO: 846116 - DNA, 20 bp, mouse
gatcaaaaacccaagatggt

SEQ ID NO: 846117 - DNA, 20 bp, mouse
gttgttctgccgaccatctt

SEQ ID NO: 846118 - DNA, 20 bp, mouse
ggaagatcaaaaacccaaga

SEQ ID NO: 846119 - DNA, 20 bp, mouse
gaatgcttctgcaatgtggg

SEQ ID NO: 846120 - DNA, 20 bp, mouse
gttggtatttcaataactgt

SEQ ID NO: 846121 - DNA, 20 bp, mouse
gaacaaattccaatgtgaac

SEQ ID NO: 846122 - DNA, 20 bp, mouse
gggatagggcaaagttatcc

SEQ ID NO: 846123 - DNA, 20 bp, mouse
gcttcaaatgcacatgttta

SEQ ID NO: 846124 - DNA, 20 bp, mouse
gaatgttaacattaaggata

SEQ ID NO: 846125 - DNA, 20 bp, mouse
gcttcaaggaagaaatctat

SEQ ID NO: 846126 - DNA, 20 bp, mouse
gaggcagtggatgatggttg

SEQ ID NO: 846127 - DNA, 20 bp, mouse
gatgttttaccattaggcag

SEQ ID NO: 846128 - DNA, 20 bp, mouse
gccccaagtggtgtagtgtc

SEQ ID NO: 846129 - DNA, 20 bp, mouse
gctgcagcttatgaaaccag

SEQ ID NO: 846130 - DNA, 20 bp, mouse
gtaatggtaaaacatcattt

SEQ ID NO: 846131 - DNA, 20 bp, mouse
gaccattaggcagtggatga

SEQ ID NO: 846132 - DNA, 20 bp, mouse
gaccatcatccactgcctaa

SEQ ID NO: 846133 - DNA, 20 bp, mouse
gaaccagacactacaccact

SEQ ID NO: 846134 - DNA, 20 bp, mouse
ggagcaattgcatttcaaac

SEQ ID NO: 846135 - DNA, 20 bp, mouse
ggggagaaacaatgataatt

SEQ ID NO: 846136 - DNA, 20 bp, mouse
ggttagtgagtccaagtgga

SEQ ID NO: 846137 - DNA, 20 bp, mouse
ggatggttagtgagtccaag

SEQ ID NO: 846138 - DNA, 20 bp, mouse
gactaaccatcgcgtttcac

SEQ ID NO: 846139 - DNA, 20 bp, mouse
gtcagtttatgaatcatact

SEQ ID NO: 846140 - DNA, 20 bp, mouse
gatagcaactgtatgctgtg

SEQ ID NO: 846141 - DNA, 20 bp, mouse
gtccatcctgtgaaacgcga

SEQ ID NO: 846142 - DNA, 20 bp, mouse
gagtgaacactccttccact

SEQ ID NO: 846143 - DNA, 20 bp, mouse
gcatctctaatggccatgtg

SEQ ID NO: 846144 - DNA, 20 bp, mouse
ggttagcattaataataatg

SEQ ID NO: 846145 - DNA, 20 bp, mouse
gaccatcgcgtttcacagga

SEQ ID NO: 846146 - DNA, 20 bp, mouse
gttatgcctgtagtgttaag

SEQ ID NO: 846147 - DNA, 20 bp, mouse
ggtattctgtgatacactac

SEQ ID NO: 846148 - DNA, 20 bp, mouse
gatgtcttatgaactcattt

SEQ ID NO: 846149 - DNA, 20 bp, mouse
gcagcttcaaacagtcacac

SEQ ID NO: 846150 - DNA, 20 bp, mouse
gaaacaatcattgaagcagt

SEQ ID NO: 846151 - DNA, 20 bp, mouse
gtattgatacccaaataatg

SEQ ID NO: 846152 - DNA, 20 bp, mouse
gcttcaaacagtcacactgg

SEQ ID NO: 846153 - DNA, 20 bp, mouse
gtatcaataaagagattatc

SEQ ID NO: 846154 - DNA, 20 bp, mouse
gtctgggatatttactgatt

SEQ ID NO: 846155 - DNA, 20 bp, mouse
gttagaaaaccccattattt

SEQ ID NO: 846156 - DNA, 20 bp, mouse
ggggttatcagtgaagatga

SEQ ID NO: 846157 - DNA, 20 bp, mouse
gtgacccttctaaacctata

SEQ ID NO: 846158 - DNA, 20 bp, mouse
gtggctaggtggtgatattt

SEQ ID NO: 846159 - DNA, 20 bp, mouse
gctgagaggcatatctggct

SEQ ID NO: 846160 - DNA, 20 bp, mouse
gtagccacatgtgacacaat

SEQ ID NO: 846161 - DNA, 20 bp, mouse
gggatactgagaggcatatc

SEQ ID NO: 846162 - DNA, 20 bp, mouse
gagaggcatatctggctagg

SEQ ID NO: 846163 - DNA, 20 bp, mouse
ggtaataatatataccttat

SEQ ID NO: 846164 - DNA, 20 bp, mouse
ggttcctattgtgtcacatg

SEQ ID NO: 846165 - DNA, 20 bp, mouse
gtattctatcaaaaaactca

SEQ ID NO: 846166 - DNA, 20 bp, mouse
gtggagcaattaaacttccc

SEQ ID NO: 846167 - DNA, 20 bp, mouse
gaacatgcttgttcctaatt

SEQ ID NO: 846168 - DNA, 20 bp, mouse
gttctaataatgatatcaat

SEQ ID NO: 846169 - DNA, 20 bp, mouse
gatattaaattattacacca

SEQ ID NO: 846170 - DNA, 20 bp, mouse
gttttgttttaccccaaatt

SEQ ID NO: 846171 - DNA, 20 bp, mouse
gtttctctgtatatagaaaa

SEQ ID NO: 846172 - DNA, 20 bp, mouse
gtggggtaaaacaaaataaa

SEQ ID NO: 846173 - DNA, 20 bp, mouse
gctaaacactatctaacagc

SEQ ID NO: 846174 - DNA, 20 bp, mouse
gcaaagaacaaaattatctt

SEQ ID NO: 846175 - DNA, 20 bp, mouse
gtgcaaatatagatgctgtt

SEQ ID NO: 846176 - DNA, 20 bp, mouse
gccaacacgcattgtgtcaa

SEQ ID NO: 846177 - DNA, 20 bp, mouse
gcaactagccaatagtcata

SEQ ID NO: 846178 - DNA, 20 bp, mouse
gtgactattggctagttgtg

SEQ ID NO: 846179 - DNA, 20 bp, mouse
gagcacaacaatatctgtaa

SEQ ID NO: 846180 - DNA, 20 bp, mouse
gacctcacagatgagtccta

SEQ ID NO: 846181 - DNA, 20 bp, mouse
ggactacaacattattaata

SEQ ID NO: 846182 - DNA, 20 bp, mouse
gtatggcttacatttaactc

SEQ ID NO: 846183 - DNA, 20 bp, mouse
gatgtaagccatatgactat

SEQ ID NO: 846184 - DNA, 20 bp, mouse
gcccataggactcatctgtg

SEQ ID NO: 846185 - DNA, 20 bp, mouse
gaagaagtgatgtatgatta

SEQ ID NO: 846186 - DNA, 20 bp, mouse
gcatatgaataatgactacg

SEQ ID NO: 846187 - DNA, 20 bp, mouse
ggcttccttgattatttaca

SEQ ID NO: 846188 - DNA, 20 bp, mouse
gcagcaggaattacagtctc

SEQ ID NO: 846189 - DNA, 20 bp, mouse
ggtatgaatacttgacttac

SEQ ID NO: 846190 - DNA, 20 bp, mouse
gataattaggcttatgcaga

SEQ ID NO: 846191 - DNA, 20 bp, mouse
gctgtacattaaaattcccg

SEQ ID NO: 846192 - DNA, 20 bp, mouse
gaaatattctagtgaacccc

SEQ ID NO: 846193 - DNA, 20 bp, mouse
gatgatttttcaggtagttg

SEQ ID NO: 846194 - DNA, 20 bp, mouse
gtattttcaaattactaatg

SEQ ID NO: 846195 - DNA, 20 bp, mouse
gatgtgtacatgatttttgc

SEQ ID NO: 846196 - DNA, 20 bp, mouse
gtgtgtaggaatcacttgca

SEQ ID NO: 846197 - DNA, 20 bp, mouse
gccatcaaaagtaaaagagc

SEQ ID NO: 846198 - DNA, 20 bp, mouse
gtgcacaaattggaaaatca

SEQ ID NO: 846199 - DNA, 20 bp, mouse
ggttatagtgaattatgact

SEQ ID NO: 846200 - DNA, 20 bp, mouse
ggacagctttaaacagcaaa

SEQ ID NO: 846201 - DNA, 20 bp, mouse
gttttgactcaatattctaa

SEQ ID NO: 846202 - DNA, 20 bp, mouse
gggttacaaaagaattacta

SEQ ID NO: 846203 - DNA, 20 bp, mouse
gtataatattctgtctgtgt

SEQ ID NO: 846204 - DNA, 20 bp, mouse
gcaatcctattgctttaaat

SEQ ID NO: 846205 - DNA, 20 bp, mouse
gcagggtatatagaaatgtc

SEQ ID NO: 846206 - DNA, 20 bp, mouse
gtatgttttgttcttctata

SEQ ID NO: 846207 - DNA, 20 bp, mouse
gtcaaataaataatacaatc

SEQ ID NO: 846208 - DNA, 20 bp, mouse
gtaaagtatagacatgtgtg

SEQ ID NO: 846209 - DNA, 20 bp, mouse
gatcaggtcattcattctca

SEQ ID NO: 846210 - DNA, 20 bp, mouse
gtactattttaattagtaaa

SEQ ID NO: 846211 - DNA, 20 bp, mouse
gattttaattagtaaaaggt

SEQ ID NO: 846212 - DNA, 20 bp, mouse
gtccatgtaccccctataca

SEQ ID NO: 846213 - DNA, 20 bp, mouse
gtataatattccatgtatag

SEQ ID NO: 846214 - DNA, 20 bp, mouse
gtccatgtatagggggtaca

SEQ ID NO: 846215 - DNA, 20 bp, mouse
gcaataggattgtgtttcta

SEQ ID NO: 846216 - DNA, 20 bp, mouse
gcaaccctattgctttaaac

SEQ ID NO: 846217 - DNA, 20 bp, mouse
gtcttactcaagaattatta

SEQ ID NO: 846218 - DNA, 20 bp, mouse
gtctctatataagaaatact

SEQ ID NO: 846219 - DNA, 20 bp, mouse
gtacaaatgtataaacactg

SEQ ID NO: 846220 - DNA, 20 bp, mouse
gaaacactgtggtcagctgg

SEQ ID NO: 846221 - DNA, 20 bp, mouse
gtatgattactttagagtaa

SEQ ID NO: 846222 - DNA, 20 bp, mouse
gtctgtagtgcacctgagac

SEQ ID NO: 846223 - DNA, 20 bp, mouse
ggagccagtttaaagcaata

SEQ ID NO: 846224 - DNA, 20 bp, mouse
gctatataagaaatacttgg

SEQ ID NO: 846225 - DNA, 20 bp, mouse
gttttaaaagtaccagtctc

SEQ ID NO: 846226 - DNA, 20 bp, mouse
gtttcatactagttgattat

SEQ ID NO: 846227 - DNA, 20 bp, mouse
gacaaaaaaatattgagggg

SEQ ID NO: 846228 - DNA, 20 bp, mouse
gaaatttattgttcacaata

SEQ ID NO: 846229 - DNA, 20 bp, mouse
gataacaaaaaaatattgag

SEQ ID NO: 846230 - DNA, 20 bp, mouse
ggtatacaggagatacatgg

SEQ ID NO: 846231 - DNA, 20 bp, mouse
gaataaaacttacgttgata

SEQ ID NO: 846232 - DNA, 20 bp, mouse
gtgagactagggggcactac

SEQ ID NO: 846233 - DNA, 20 bp, mouse
gtctaaaacatgagactagg

SEQ ID NO: 846234 - DNA, 20 bp, mouse
gcacaatatggtaagtatac

SEQ ID NO: 846235 - DNA, 20 bp, mouse
ggagtcaatttaaatcaaca

SEQ ID NO: 846236 - DNA, 20 bp, mouse
gcatattaaatgtgctacat

SEQ ID NO: 846237 - DNA, 20 bp, mouse
ggaatcaacttaatagtgat

SEQ ID NO: 846238 - DNA, 20 bp, mouse
gttttttatcgacacactta

SEQ ID NO: 846239 - DNA, 20 bp, mouse
gacaaatatttacaaagcaa

SEQ ID NO: 846240 - DNA, 20 bp, mouse
gaatgagtgactattctctg

SEQ ID NO: 846241 - DNA, 20 bp, mouse
ggaaaagactatagctacca

SEQ ID NO: 846242 - DNA, 20 bp, mouse
ggttaacaactctgtagcca

SEQ ID NO: 846243 - DNA, 20 bp, mouse
ggaaaaacaattgcagttat

SEQ ID NO: 846244 - DNA, 20 bp, mouse
gcatcttctaaatgatcaag

SEQ ID NO: 846245 - DNA, 20 bp, mouse
gaaaaaaaacatcataagag

SEQ ID NO: 846246 - DNA, 20 bp, mouse
gactaaacaaagaggtacat

SEQ ID NO: 846247 - DNA, 20 bp, mouse
gactattgcagggtaggcaa

SEQ ID NO: 846248 - DNA, 20 bp, mouse
ggtacataggtaaaatatca

SEQ ID NO: 846249 - DNA, 20 bp, mouse
ggagcagaaaaccagagtat

SEQ ID NO: 846250 - DNA, 20 bp, mouse
ggcaaaacaggactattgca

SEQ ID NO: 846251 - DNA, 20 bp, mouse
gccaaacacctttgtgagaa

SEQ ID NO: 846252 - DNA, 20 bp, mouse
gaacaggactattgcagggt

SEQ ID NO: 846253 - DNA, 20 bp, mouse
gatgcatttttcttggtagc

SEQ ID NO: 846254 - DNA, 20 bp, mouse
gctgaagtcctttctcacaa

SEQ ID NO: 846255 - DNA, 20 bp, mouse
gtttcttgatacctatactc

SEQ ID NO: 846256 - DNA, 20 bp, mouse
gtgtatagggggtacacgga

SEQ ID NO: 846257 - DNA, 20 bp, mouse
gataaaacatatgtagtctt

SEQ ID NO: 846258 - DNA, 20 bp, mouse
gagaattcagagccaaaaca

SEQ ID NO: 846259 - DNA, 20 bp, mouse
ggaaagtatagatatgagtg

SEQ ID NO: 846260 - DNA, 20 bp, mouse
gggatggtatataaaaatgt

SEQ ID NO: 846261 - DNA, 20 bp, mouse
gaaacaattattcattctca

SEQ ID NO: 846262 - DNA, 20 bp, mouse
gcactattttaattagtaaa

SEQ ID NO: 846263 - DNA, 20 bp, mouse
gttcacagctatccatgttt

SEQ ID NO: 846264 - DNA, 20 bp, mouse
gtccatgtatagggggtaca

SEQ ID NO: 846265 - DNA, 20 bp, mouse
gtataatattccatgtatag

SEQ ID NO: 846266 - DNA, 20 bp, mouse
ggtgctcaccatgactgttt

SEQ ID NO: 846267 - DNA, 20 bp, mouse
gtgaattctgtatatgtgaa

SEQ ID NO: 846268 - DNA, 20 bp, mouse
gttccttactagttgaagat

SEQ ID NO: 846269 - DNA, 20 bp, mouse
gcataaaaatagatgaattg

SEQ ID NO: 846270 - DNA, 20 bp, mouse
gaattatgtcataacataga

SEQ ID NO: 846271 - DNA, 20 bp, mouse
gagaaatttgctaattaaaa

SEQ ID NO: 846272 - DNA, 20 bp, mouse
gatttgctaattaaaatggt

SEQ ID NO: 846273 - DNA, 20 bp, mouse
gttagcatccaaaacagtca

SEQ ID NO: 846274 - DNA, 20 bp, mouse
gtataatattgtatgtatac

SEQ ID NO: 846275 - DNA, 20 bp, mouse
gtagtaaggaaaataaaatg

SEQ ID NO: 846276 - DNA, 20 bp, mouse
gtagctatgggtctagaggg

SEQ ID NO: 846277 - DNA, 20 bp, mouse
gacaaagttgcaccatgaaa

SEQ ID NO: 846278 - DNA, 20 bp, mouse
gaagagaccctgaactatgg

SEQ ID NO: 846279 - DNA, 20 bp, mouse
gctagagggaggtgaggtga

SEQ ID NO: 846280 - DNA, 20 bp, mouse
ggtaagcaggaaggatcctt

SEQ ID NO: 846281 - DNA, 20 bp, mouse
gtagaagagaccctgaacta

SEQ ID NO: 846282 - DNA, 20 bp, mouse
gtcctactctactgtactcc

SEQ ID NO: 846283 - DNA, 20 bp, mouse
gtagaaatggggtttggggc

SEQ ID NO: 846284 - DNA, 20 bp, mouse
gcagatgacaccatagctat

SEQ ID NO: 846285 - DNA, 20 bp, mouse
gtggtagcctccatagttca

SEQ ID NO: 846286 - DNA, 20 bp, mouse
gcctctcattgcgtcaatga

SEQ ID NO: 846287 - DNA, 20 bp, mouse
gaatttcaacatgtagagac

SEQ ID NO: 846288 - DNA, 20 bp, mouse
gtgctcttcattatattttt

SEQ ID NO: 846289 - DNA, 20 bp, mouse
gagagggaggataggatatg

SEQ ID NO: 846290 - DNA, 20 bp, mouse
gctggaggggaaatgtggaa

SEQ ID NO: 846291 - DNA, 20 bp, mouse
gaggtgttaactacaaaatg

SEQ ID NO: 846292 - DNA, 20 bp, mouse
gactggatttctaaggtatg

SEQ ID NO: 846293 - DNA, 20 bp, mouse
gacatgttgaaattccatac

SEQ ID NO: 846294 - DNA, 20 bp, mouse
gtgatttaaatcaataggac

SEQ ID NO: 846295 - DNA, 20 bp, mouse
gaggatatggggtttctgga

SEQ ID NO: 846296 - DNA, 20 bp, mouse
ggatgatgttggttgatgta

SEQ ID NO: 846297 - DNA, 20 bp, mouse
gaaatcaaatactgatatga

SEQ ID NO: 846298 - DNA, 20 bp, mouse
gactgatatgaagggtgaat

SEQ ID NO: 846299 - DNA, 20 bp, mouse
ggaactagctttggtggcaa

SEQ ID NO: 846300 - DNA, 20 bp, mouse
gttggaagcatgtagagctt

SEQ ID NO: 846301 - DNA, 20 bp, mouse
gaagtgaatatgtgactttt

SEQ ID NO: 846302 - DNA, 20 bp, mouse
gtaaatctccacaaagcagt

SEQ ID NO: 846303 - DNA, 20 bp, mouse
gagggtgaattggtttttct

SEQ ID NO: 846304 - DNA, 20 bp, mouse
ggtcttgtttgatcaatttc

SEQ ID NO: 846305 - DNA, 20 bp, mouse
ggtaagtcttcataactctc

SEQ ID NO: 846306 - DNA, 20 bp, mouse
gtctggaggggaaactgaat

SEQ ID NO: 846307 - DNA, 20 bp, mouse
gttaggtggcttaagtcaat

SEQ ID NO: 846308 - DNA, 20 bp, mouse
gtgtaggggatgccagagcc

SEQ ID NO: 846309 - DNA, 20 bp, mouse
gagaacaccttcatataagc

SEQ ID NO: 846310 - DNA, 20 bp, mouse
gctcaccaactccctcctcc

SEQ ID NO: 846311 - DNA, 20 bp, mouse
gtggcttaagtcaataggac

SEQ ID NO: 846312 - DNA, 20 bp, mouse
gggatttctaagatatgagg

SEQ ID NO: 846313 - DNA, 20 bp, mouse
gatacttattattttttaat

SEQ ID NO: 846314 - DNA, 20 bp, mouse
gataccattctatacagaga

SEQ ID NO: 846315 - DNA, 20 bp, mouse
ggatgccagagccaggagga

SEQ ID NO: 846316 - DNA, 20 bp, mouse
gcatccgaggatcctaagtt

SEQ ID NO: 846317 - DNA, 20 bp, mouse
gggatagaatagggcgtttc

SEQ ID NO: 846318 - DNA, 20 bp, mouse
gacaccaaacttaggatcct

SEQ ID NO: 846319 - DNA, 20 bp, mouse
gatgcagctatactcatccg

SEQ ID NO: 846320 - DNA, 20 bp, mouse
gctaagatatgaggacgctc

SEQ ID NO: 846321 - DNA, 20 bp, mouse
gtattagatacaccaaactt

SEQ ID NO: 846322 - DNA, 20 bp, mouse
gggaaagggaggatagaata

SEQ ID NO: 846323 - DNA, 20 bp, mouse
gtgtcatagaatcagggaaa

SEQ ID NO: 846324 - DNA, 20 bp, mouse
ggaatagggcgtttctgggg

SEQ ID NO: 846325 - DNA, 20 bp, mouse
ggagaactgtcatagaatca

SEQ ID NO: 846326 - DNA, 20 bp, mouse
ggtttcctctccagaaaccc

SEQ ID NO: 846327 - DNA, 20 bp, mouse
gggaggctcaggtgtaataa

SEQ ID NO: 846328 - DNA, 20 bp, mouse
gtaggaaattatgtccagtt

SEQ ID NO: 846329 - DNA, 20 bp, mouse
gaataaaggcccacaaattg

SEQ ID NO: 846330 - DNA, 20 bp, mouse
gatgacgtgatttaagtcat

SEQ ID NO: 846331 - DNA, 20 bp, mouse
ggtgatttaagtcataggac

SEQ ID NO: 846332 - DNA, 20 bp, mouse
gagagcaaggatggaatcca

SEQ ID NO: 846333 - DNA, 20 bp, mouse
gggatggaatccagggtttc

SEQ ID NO: 846334 - DNA, 20 bp, mouse
gctgaaagggggataacatt

SEQ ID NO: 846335 - DNA, 20 bp, mouse
ggaagtattatcatagaagc

SEQ ID NO: 846336 - DNA, 20 bp, mouse
gtgagggaggatggaatact

SEQ ID NO: 846337 - DNA, 20 bp, mouse
gaattccaaagatgggaggt

SEQ ID NO: 846338 - DNA, 20 bp, mouse
gtgtcgggaattccaaagat

SEQ ID NO: 846339 - DNA, 20 bp, mouse
gtttggaattcccgacattg

SEQ ID NO: 846340 - DNA, 20 bp, mouse
gtaggaaatgatgtccattt

SEQ ID NO: 846341 - DNA, 20 bp, mouse
gggatcaggtgtaataataa

SEQ ID NO: 846342 - DNA, 20 bp, mouse
gctaagatatgaggaggatc

SEQ ID NO: 846343 - DNA, 20 bp, mouse
gtgacgtgatttaagtcaac

SEQ ID NO: 846344 - DNA, 20 bp, mouse
gcatagaagcagagtgaggg

SEQ ID NO: 846345 - DNA, 20 bp, mouse
gtatcatagaagcagagtga

SEQ ID NO: 846346 - DNA, 20 bp, mouse
gagtagctaaaaaacaataa

SEQ ID NO: 846347 - DNA, 20 bp, mouse
ggagagatatataggaatgt

SEQ ID NO: 846348 - DNA, 20 bp, mouse
gtgagatgatttaattcaat

SEQ ID NO: 846349 - DNA, 20 bp, mouse
ggatacatagagagatatat

SEQ ID NO: 846350 - DNA, 20 bp, mouse
gctggggcatagcaaaatta

SEQ ID NO: 846351 - DNA, 20 bp, mouse
gacatcaaaatttagagaca

SEQ ID NO: 846352 - DNA, 20 bp, mouse
gtataagatctcttggaaaa

SEQ ID NO: 846353 - DNA, 20 bp, mouse
gacatggatagttgcaaact

SEQ ID NO: 846354 - DNA, 20 bp, mouse
gtgctcatcactataatttt

SEQ ID NO: 846355 - DNA, 20 bp, mouse
gtgaagtattaatcatgaca

SEQ ID NO: 846356 - DNA, 20 bp, mouse
ggtgggtgggtgggtcgagg

SEQ ID NO: 846357 - DNA, 20 bp, mouse
gctggggcatagcaaaattg

SEQ ID NO: 846358 - DNA, 20 bp, mouse
gaacatcaaaagttacagac

SEQ ID NO: 846359 - DNA, 20 bp, mouse
gtgctcatcactataccaat

SEQ ID NO: 846360 - DNA, 20 bp, mouse
gcttacaaatccagtcctat

SEQ ID NO: 846361 - DNA, 20 bp, mouse
gatcactataccaataggac

SEQ ID NO: 846362 - DNA, 20 bp, mouse
gagaggggaaagcaggaaat

SEQ ID NO: 846363 - DNA, 20 bp, mouse
gtgggatggggtttttcaga

SEQ ID NO: 846364 - DNA, 20 bp, mouse
gaacttttgatgtttcatac

SEQ ID NO: 846365 - DNA, 20 bp, mouse
ggggagagggaggttgggat

SEQ ID NO: 846366 - DNA, 20 bp, mouse
gcgacggggcggagactaag

SEQ ID NO: 846367 - DNA, 20 bp, mouse
gaggaggccccgcccagaag

SEQ ID NO: 846368 - DNA, 20 bp, mouse
gggggctccggggaagtgtg

SEQ ID NO: 846369 - DNA, 20 bp, mouse
gccccgcccagaagaggtga

SEQ ID NO: 846370 - DNA, 20 bp, mouse
gaagtcccgcccccactata

SEQ ID NO: 846371 - DNA, 20 bp, mouse
gcgcggaagcccgggatccg

SEQ ID NO: 846372 - DNA, 20 bp, mouse
gccgcccccactataagggc

SEQ ID NO: 846373 - DNA, 20 bp, mouse
ggatccgcgggtacgagccc

SEQ ID NO: 846374 - DNA, 20 bp, mouse
gcgcaagccgcacacttccc

SEQ ID NO: 846375 - DNA, 20 bp, mouse
gaatcccgcccttatagtgg

SEQ ID NO: 846376 - DNA, 20 bp, mouse
gagttcggatgacatggaat

SEQ ID NO: 846377 - DNA, 20 bp, mouse
ggctttgaggtggtaagagc

SEQ ID NO: 846378 - DNA, 20 bp, mouse
gtggaggactgtatgatgac

SEQ ID NO: 846379 - DNA, 20 bp, mouse
gtttggaagtagccccacaa

SEQ ID NO: 846380 - DNA, 20 bp, mouse
ggagttgagttcggatgaca

SEQ ID NO: 846381 - DNA, 20 bp, mouse
gcaaacccttggaaaatgag

SEQ ID NO: 846382 - DNA, 20 bp, mouse
gacatgttggtgcttggtgt

SEQ ID NO: 846383 - DNA, 20 bp, mouse
ggaaaacgaccctgtgtata

SEQ ID NO: 846384 - DNA, 20 bp, mouse
gaaaagctgcatctcattga

SEQ ID NO: 846385 - DNA, 20 bp, mouse
gccagaacaaaccaaaccct

SEQ ID NO: 846386 - DNA, 20 bp, mouse
gcagtggggacagtaggcat

SEQ ID NO: 846387 - DNA, 20 bp, mouse
gccaggacaaaccacatcca

SEQ ID NO: 846388 - DNA, 20 bp, mouse
gagcacatggtccctggatg

SEQ ID NO: 846389 - DNA, 20 bp, mouse
gttaaaatgtgccctcctgg

SEQ ID NO: 846390 - DNA, 20 bp, mouse
gtagatgtagctcttggccc

SEQ ID NO: 846391 - DNA, 20 bp, mouse
gcccatgggttctagtgcac

SEQ ID NO: 846392 - DNA, 20 bp, mouse
gagagagagatttgacttgg

SEQ ID NO: 846393 - DNA, 20 bp, mouse
gaacttaaaatgtgccctcc

SEQ ID NO: 846394 - DNA, 20 bp, mouse
gcacaatagctttatacatt

SEQ ID NO: 846395 - DNA, 20 bp, mouse
ggacagtaggcatgggtttg

SEQ ID NO: 846396 - DNA, 20 bp, mouse
ggataacaactatctgggga

SEQ ID NO: 846397 - DNA, 20 bp, mouse
gcccactggagcatcttccc

SEQ ID NO: 846398 - DNA, 20 bp, mouse
ggatctggataacaactatc

SEQ ID NO: 846399 - DNA, 20 bp, mouse
gcagaataagatcatagcca

SEQ ID NO: 846400 - DNA, 20 bp, mouse
gtggagacctggcaacccac

SEQ ID NO: 846401 - DNA, 20 bp, mouse
gcaactatctggggagggct

SEQ ID NO: 846402 - DNA, 20 bp, mouse
gcaagagcctcagagccaat

SEQ ID NO: 846403 - DNA, 20 bp, mouse
gtgagggttgaccctgcaaa

SEQ ID NO: 846404 - DNA, 20 bp, mouse
gtatacctgagttgtctaat

SEQ ID NO: 846405 - DNA, 20 bp, mouse
gttaacaggcaaccttttgc

SEQ ID NO: 846406 - DNA, 20 bp, mouse
gtgaacagctatgaagatct

SEQ ID NO: 846407 - DNA, 20 bp, mouse
ggcaggaacagcatcgtatt

SEQ ID NO: 846408 - DNA, 20 bp, mouse
gatgaagatctgggagtgta

SEQ ID NO: 846409 - DNA, 20 bp, mouse
gatgcacacatcatagatta

SEQ ID NO: 846410 - DNA, 20 bp, mouse
gaggtcctgtgtattggtta

SEQ ID NO: 846411 - DNA, 20 bp, mouse
ggtgcattatttaatgttaa

SEQ ID NO: 846412 - DNA, 20 bp, mouse
gatgtccttgaggaggtgac

SEQ ID NO: 846413 - DNA, 20 bp, mouse
gagagttttactattttggg

SEQ ID NO: 846414 - DNA, 20 bp, mouse
gtgtgtatatgtccttgagg

SEQ ID NO: 846415 - DNA, 20 bp, mouse
gctctttcattgggaagatc

SEQ ID NO: 846416 - DNA, 20 bp, mouse
gccaacctgacacaggtaca

SEQ ID NO: 846417 - DNA, 20 bp, mouse
gccatggatcctgtcttcta

SEQ ID NO: 846418 - DNA, 20 bp, mouse
gtgcaaccaccatagaagac

SEQ ID NO: 846419 - DNA, 20 bp, mouse
gcccaatgaaagagttcatg

SEQ ID NO: 846420 - DNA, 20 bp, mouse
gctcagagtattctaggtct

SEQ ID NO: 846421 - DNA, 20 bp, mouse
gatgttcatgagtaggtggc

SEQ ID NO: 846422 - DNA, 20 bp, mouse
gttctaggtcttggttaaaa

SEQ ID NO: 846423 - DNA, 20 bp, mouse
ggtatatgttcatgagtagg

SEQ ID NO: 846424 - DNA, 20 bp, mouse
gatcttaagaaaattggttt

SEQ ID NO: 846425 - DNA, 20 bp, mouse
gataatgttgctggcagtga

SEQ ID NO: 846426 - DNA, 20 bp, mouse
gcaattgtgtgcatcatcat

SEQ ID NO: 846427 - DNA, 20 bp, mouse
gcacagtagctttacatatc

SEQ ID NO: 846428 - DNA, 20 bp, mouse
gatctcctggtccactggtt

SEQ ID NO: 846429 - DNA, 20 bp, mouse
gataaaatgacactgtgcac

SEQ ID NO: 846430 - DNA, 20 bp, mouse
ggtagaaatgtacctcctgg

SEQ ID NO: 846431 - DNA, 20 bp, mouse
gaaagagaacaaagttggta

SEQ ID NO: 846432 - DNA, 20 bp, mouse
gtatgaatcattccatctcc

SEQ ID NO: 846433 - DNA, 20 bp, mouse
gaaagttggtatggggttga

SEQ ID NO: 846434 - DNA, 20 bp, mouse
ggaatgaatatttggcctgc

SEQ ID NO: 846435 - DNA, 20 bp, mouse
gattccatctcctggtccac

SEQ ID NO: 846436 - DNA, 20 bp, mouse
gaatctacacagtgagtggt

SEQ ID NO: 846437 - DNA, 20 bp, mouse
gatcaagatttcttgaatac

SEQ ID NO: 846438 - DNA, 20 bp, mouse
gaaggaaatctggaagtcat

SEQ ID NO: 846439 - DNA, 20 bp, mouse
gtggaagtaaagtaagattt

SEQ ID NO: 846440 - DNA, 20 bp, mouse
gttactaagagaaggaaatc

SEQ ID NO: 846441 - DNA, 20 bp, mouse
gtgagaaacatggaagttca

SEQ ID NO: 846442 - DNA, 20 bp, mouse
ggtggtgggatgcttgatcc

SEQ ID NO: 846443 - DNA, 20 bp, mouse
gattaaatctacacagtgag

SEQ ID NO: 846444 - DNA, 20 bp, mouse
gtccatgtcttgaaggaacc

SEQ ID NO: 846445 - DNA, 20 bp, mouse
gtccaggttccttcaagaca

SEQ ID NO: 846446 - DNA, 20 bp, mouse
ggtgacatggaatcaggatg

SEQ ID NO: 846447 - DNA, 20 bp, mouse
gtgtttggtgacatggaatc

SEQ ID NO: 846448 - DNA, 20 bp, mouse
gcctgtgaactggaacctat

SEQ ID NO: 846449 - DNA, 20 bp, mouse
gtatgagctagagctgtgtt

SEQ ID NO: 846450 - DNA, 20 bp, mouse
gagagctgtgtttggtgaca

SEQ ID NO: 846451 - DNA, 20 bp, mouse
gggcaagagatgcatctcac

SEQ ID NO: 846452 - DNA, 20 bp, mouse
gcaaagtagcttaacatgtc

SEQ ID NO: 846453 - DNA, 20 bp, mouse
gaacaaagccatattttgta

SEQ ID NO: 846454 - DNA, 20 bp, mouse
gataaagtgcccctgtgaac

SEQ ID NO: 846455 - DNA, 20 bp, mouse
gcactcttccttacaaaata

SEQ ID NO: 846456 - DNA, 20 bp, mouse
gggatggaaggcaaaacatc

SEQ ID NO: 846457 - DNA, 20 bp, mouse
ggaagggtaagatgatctgt

SEQ ID NO: 846458 - DNA, 20 bp, mouse
gcccttcctaagttgagcga

SEQ ID NO: 846459 - DNA, 20 bp, mouse
gtacagccatcgctcaactt

SEQ ID NO: 846460 - DNA, 20 bp, mouse
gggaagtagagttaccaagg

SEQ ID NO: 846461 - DNA, 20 bp, mouse
gggctgtatcctgtatcctg

SEQ ID NO: 846462 - DNA, 20 bp, mouse
gccaatgaaagaggtcctgt

SEQ ID NO: 846463 - DNA, 20 bp, mouse
gacactgatgcagccaccac

SEQ ID NO: 846464 - DNA, 20 bp, mouse
ggtagagttaccaaggagga

SEQ ID NO: 846465 - DNA, 20 bp, mouse
ggccatcgctcaacttagga

SEQ ID NO: 846466 - DNA, 20 bp, mouse
gggatggaaggcaaaacatc

SEQ ID NO: 846467 - DNA, 20 bp, mouse
ggaagggtaagatgatctgt

SEQ ID NO: 846468 - DNA, 20 bp, mouse
gcccttcctaagttgagcga

SEQ ID NO: 846469 - DNA, 20 bp, mouse
gtacagccatcgctcaactt

SEQ ID NO: 846470 - DNA, 20 bp, mouse
gggaagtagagttaccaagg

SEQ ID NO: 846471 - DNA, 20 bp, mouse
gggctgtatcctgtatcctg

SEQ ID NO: 846472 - DNA, 20 bp, mouse
gccaatgaaagaggtcctgt

SEQ ID NO: 846473 - DNA, 20 bp, mouse
gacactgatgcagccaccac

SEQ ID NO: 846474 - DNA, 20 bp, mouse
ggtagagttaccaaggagga

SEQ ID NO: 846475 - DNA, 20 bp, mouse
ggccatcgctcaacttagga

SEQ ID NO: 846476 - DNA, 20 bp, mouse
gtaggacaatgggaacagtg

SEQ ID NO: 846477 - DNA, 20 bp, mouse
gttgggaagcattaggacaa

SEQ ID NO: 846478 - DNA, 20 bp, mouse
gcctgtgctctggaacttat

SEQ ID NO: 846479 - DNA, 20 bp, mouse
gaaagaattcagcactgatt

SEQ ID NO: 846480 - DNA, 20 bp, mouse
gaattctttgtaccaattta

SEQ ID NO: 846481 - DNA, 20 bp, mouse
gctgcagctcacttgataaa

SEQ ID NO: 846482 - DNA, 20 bp, mouse
gagagagagaatacttggat

SEQ ID NO: 846483 - DNA, 20 bp, mouse
gcatttcccttcatggttct

SEQ ID NO: 846484 - DNA, 20 bp, mouse
gataaaatgaccctgtgctc

SEQ ID NO: 846485 - DNA, 20 bp, mouse
gcaaaagaactttaagtatc

SEQ ID NO: 846486 - DNA, 20 bp, mouse
gatctgtacagaatactcag

SEQ ID NO: 846487 - DNA, 20 bp, mouse
ggcagatacatggaagtagc

SEQ ID NO: 846488 - DNA, 20 bp, mouse
gcaataggatcatatttcta

SEQ ID NO: 846489 - DNA, 20 bp, mouse
gactgaatcacctgatatat

SEQ ID NO: 846490 - DNA, 20 bp, mouse
gtttaaatgccttgttctgt

SEQ ID NO: 846491 - DNA, 20 bp, mouse
gcattaagtttgagatacac

SEQ ID NO: 846492 - DNA, 20 bp, mouse
gaatctttacctacagaaca

SEQ ID NO: 846493 - DNA, 20 bp, mouse
gtttgtcagattgaaatagt

SEQ ID NO: 846494 - DNA, 20 bp, mouse
gatggaagtagcaggaatat

SEQ ID NO: 846495 - DNA, 20 bp, mouse
gacaaggcatttaaatcaat

SEQ ID NO: 846496 - DNA, 20 bp, mouse
gttaggacagttcagacagt

SEQ ID NO: 846497 - DNA, 20 bp, mouse
gccagggaccatgagttgaa

SEQ ID NO: 846498 - DNA, 20 bp, mouse
ggcactgattggaatgcatt

SEQ ID NO: 846499 - DNA, 20 bp, mouse
gaacaaggctgtgttttgta

SEQ ID NO: 846500 - DNA, 20 bp, mouse
ggctttacttatctggtgaa

SEQ ID NO: 846501 - DNA, 20 bp, mouse
gtggttgggattcgtgaaca

SEQ ID NO: 846502 - DNA, 20 bp, mouse
gcttcttgccatctaggtgt

SEQ ID NO: 846503 - DNA, 20 bp, mouse
gagaatgcacaatgaatatt

SEQ ID NO: 846504 - DNA, 20 bp, mouse
gatcccaaccaacacctaga

SEQ ID NO: 846505 - DNA, 20 bp, mouse
ggactgtgtgcccactgcac

SEQ ID NO: 846506 - DNA, 20 bp, mouse
ggaattccaaaacagaacac

SEQ ID NO: 846507 - DNA, 20 bp, mouse
gctatttcaagcatggatgg

SEQ ID NO: 846508 - DNA, 20 bp, mouse
gtctttcagtatatacatca

SEQ ID NO: 846509 - DNA, 20 bp, mouse
gaactacaattaaaagtatt

SEQ ID NO: 846510 - DNA, 20 bp, mouse
gcttctatttcaagcatgga

SEQ ID NO: 846511 - DNA, 20 bp, mouse
gagcattactaaaccaatgt

SEQ ID NO: 846512 - DNA, 20 bp, mouse
gaagtatcaactttcaatta

SEQ ID NO: 846513 - DNA, 20 bp, mouse
gtgcaagagaatagcaaagt

SEQ ID NO: 846514 - DNA, 20 bp, mouse
gccaaaacagaacactggag

SEQ ID NO: 846515 - DNA, 20 bp, mouse
gcctttccagagaactcagg

SEQ ID NO: 846516 - DNA, 20 bp, mouse
gctggaaagttggaagtcac

SEQ ID NO: 846517 - DNA, 20 bp, mouse
gtaaatctatattaagtggc

SEQ ID NO: 846518 - DNA, 20 bp, mouse
gaacacgatttcttggatgc

SEQ ID NO: 846519 - DNA, 20 bp, mouse
ggtacagaaacacgatttct

SEQ ID NO: 846520 - DNA, 20 bp, mouse
gccttagtaaacagtaaaaa

SEQ ID NO: 846521 - DNA, 20 bp, mouse
gtttactgtttactaaggtc

SEQ ID NO: 846522 - DNA, 20 bp, mouse
gtctctgtgttgaaagatcc

SEQ ID NO: 846523 - DNA, 20 bp, mouse
gtcagaaacatggaagctca

SEQ ID NO: 846524 - DNA, 20 bp, mouse
gtgattaaatctatattaag

SEQ ID NO: 846525 - DNA, 20 bp, mouse
gtggattttaagaaaaattt

SEQ ID NO: 846526 - DNA, 20 bp, mouse
gtagaaaatatgtaagagta

SEQ ID NO: 846527 - DNA, 20 bp, mouse
gggacatgaggtaataagaa

SEQ ID NO: 846528 - DNA, 20 bp, mouse
gaaatatgtaagagtaggga

SEQ ID NO: 846529 - DNA, 20 bp, mouse
gtacctcatgtccatttaac

SEQ ID NO: 846530 - DNA, 20 bp, mouse
gtattcaactattacatgag

SEQ ID NO: 846531 - DNA, 20 bp, mouse
gatgacaaaaatatttggtc

SEQ ID NO: 846532 - DNA, 20 bp, mouse
gtaatgtatggaattttatt

SEQ ID NO: 846533 - DNA, 20 bp, mouse
gtattttcagtgaaactgaa

SEQ ID NO: 846534 - DNA, 20 bp, mouse
gctttgagttttctaatgca

SEQ ID NO: 846535 - DNA, 20 bp, mouse
gggtctggcaataaatgaaa

SEQ ID NO: 846536 - DNA, 20 bp, mouse
gtaaacccatggagcaggag

SEQ ID NO: 846537 - DNA, 20 bp, mouse
gcctgtgcagaggaacccat

SEQ ID NO: 846538 - DNA, 20 bp, mouse
gtttggaggtagcccgacaa

SEQ ID NO: 846539 - DNA, 20 bp, mouse
ggacagtggtgctatctttg

SEQ ID NO: 846540 - DNA, 20 bp, mouse
gaattgtgtgcaccattgtc

SEQ ID NO: 846541 - DNA, 20 bp, mouse
gattcccactcctgctccat

SEQ ID NO: 846542 - DNA, 20 bp, mouse
gtaaactaaacccatggagc

SEQ ID NO: 846543 - DNA, 20 bp, mouse
gactgtgactatgtgcccat

SEQ ID NO: 846544 - DNA, 20 bp, mouse
ggttgtctgacaattaagtg

SEQ ID NO: 846545 - DNA, 20 bp, mouse
ggtgtgagctggacctgatt

SEQ ID NO: 846546 - DNA, 20 bp, mouse
gaaagagtggacatggcttc

SEQ ID NO: 846547 - DNA, 20 bp, mouse
gatggcagaaagagtggaca

SEQ ID NO: 846548 - DNA, 20 bp, mouse
gaggtagggcgcatgactat

SEQ ID NO: 846549 - DNA, 20 bp, mouse
ggggcgcatgactattggaa

SEQ ID NO: 846550 - DNA, 20 bp, mouse
ggcttctggacgccttgaag

SEQ ID NO: 846551 - DNA, 20 bp, mouse
gttaaactgccatgtgtcat

SEQ ID NO: 846552 - DNA, 20 bp, mouse
gagaaagcttatgtacaggt

SEQ ID NO: 846553 - DNA, 20 bp, mouse
gtgtaagaaagcttatgtac

SEQ ID NO: 846554 - DNA, 20 bp, mouse
gagcacaaacaaagatagac

SEQ ID NO: 846555 - DNA, 20 bp, mouse
ggagccacacaaagggcact

SEQ ID NO: 846556 - DNA, 20 bp, mouse
gctcataaaggggaagtgtc

SEQ ID NO: 846557 - DNA, 20 bp, mouse
gggaaagtggtgttggcatc

SEQ ID NO: 846558 - DNA, 20 bp, mouse
ggttggcatcaggtgtagag

SEQ ID NO: 846559 - DNA, 20 bp, mouse
gttaagtgggaaagtggtgt

SEQ ID NO: 846560 - DNA, 20 bp, mouse
gtggtgatggtctatctgga

SEQ ID NO: 846561 - DNA, 20 bp, mouse
gctgatatcagagctcataa

SEQ ID NO: 846562 - DNA, 20 bp, mouse
gtgcctggtgatggtctatc

SEQ ID NO: 846563 - DNA, 20 bp, mouse
gaatgcccttgtccacacat

SEQ ID NO: 846564 - DNA, 20 bp, mouse
gccttagggagtatttaagt

SEQ ID NO: 846565 - DNA, 20 bp, mouse
gcatcaccattttcctttcc

SEQ ID NO: 846566 - DNA, 20 bp, mouse
ggtacagaatactcacttag

SEQ ID NO: 846567 - DNA, 20 bp, mouse
ggcagatacatggaagtaat

SEQ ID NO: 846568 - DNA, 20 bp, mouse
ggaatactcacttagtggct

SEQ ID NO: 846569 - DNA, 20 bp, mouse
gaattctattgcaatcgcag

SEQ ID NO: 846570 - DNA, 20 bp, mouse
gcaaagaaattcagtatatc

SEQ ID NO: 846571 - DNA, 20 bp, mouse
gatgaggcaattaattcaat

SEQ ID NO: 846572 - DNA, 20 bp, mouse
ggcaattaattcaataggat

SEQ ID NO: 846573 - DNA, 20 bp, mouse
gcaatcgcagtggtaattca

SEQ ID NO: 846574 - DNA, 20 bp, mouse
ggtgaatcatattcctgcaa

SEQ ID NO: 846575 - DNA, 20 bp, mouse
gatggattgagaaagatatt

SEQ ID NO: 846576 - DNA, 20 bp, mouse
gttatcattagtgaaaagaa

SEQ ID NO: 846577 - DNA, 20 bp, mouse
gaattgtttttcaatcgatt

SEQ ID NO: 846578 - DNA, 20 bp, mouse
gacacattttaaaacagctt

SEQ ID NO: 846579 - DNA, 20 bp, mouse
gtgtgctatgaagccatctc

SEQ ID NO: 846580 - DNA, 20 bp, mouse
gataattgagaaaattcttc

SEQ ID NO: 846581 - DNA, 20 bp, mouse
gagaaatacaattgtgttgt

SEQ ID NO: 846582 - DNA, 20 bp, mouse
gctgtagtgtgtcaaagcag

SEQ ID NO: 846583 - DNA, 20 bp, mouse
gcactacaggagattttttc

SEQ ID NO: 846584 - DNA, 20 bp, mouse
ggcatgctgttgaacaacac

SEQ ID NO: 846585 - DNA, 20 bp, mouse
ggttgttggagagatgattt

SEQ ID NO: 846586 - DNA, 20 bp, mouse
gaaggtcactcagtagttaa

SEQ ID NO: 846587 - DNA, 20 bp, mouse
gaattcaaggcaaacaatgg

SEQ ID NO: 846588 - DNA, 20 bp, mouse
gttcaattcaaggcaaacaa

SEQ ID NO: 846589 - DNA, 20 bp, mouse
ggccttgaattgaactcttt

SEQ ID NO: 846590 - DNA, 20 bp, mouse
gtcatatttgatataaaaca

SEQ ID NO: 846591 - DNA, 20 bp, mouse
gtccaaaagagttcaattca

SEQ ID NO: 846592 - DNA, 20 bp, mouse
gtatgaatgaggaactgaga

SEQ ID NO: 846593 - DNA, 20 bp, mouse
gtttatatcaaatatgaatg

SEQ ID NO: 846594 - DNA, 20 bp, mouse
gcacttgtattcattcattt

SEQ ID NO: 846595 - DNA, 20 bp, mouse
ggcattatatgtattaattt

SEQ ID NO: 846596 - DNA, 20 bp, mouse
gctcataaagggggagtgcc

SEQ ID NO: 846597 - DNA, 20 bp, mouse
gaatgaatcagagctcataa

SEQ ID NO: 846598 - DNA, 20 bp, mouse
gtggtgatgatatgtctgga

SEQ ID NO: 846599 - DNA, 20 bp, mouse
gtgcctggtgatgatatgtc

SEQ ID NO: 846600 - DNA, 20 bp, mouse
gtcagaagtatttcaggacc

SEQ ID NO: 846601 - DNA, 20 bp, mouse
gaattaccaggaagtgaaaa

SEQ ID NO: 846602 - DNA, 20 bp, mouse
ggaatcagagctcataaagg

SEQ ID NO: 846603 - DNA, 20 bp, mouse
ggttgtcatcaggtataaag

SEQ ID NO: 846604 - DNA, 20 bp, mouse
gcatcaccattttcacttcc

SEQ ID NO: 846605 - DNA, 20 bp, mouse
ggagtatttaggtggtaaag

SEQ ID NO: 846606 - DNA, 20 bp, mouse
gcactgctttagcacactac

SEQ ID NO: 846607 - DNA, 20 bp, mouse
gattgatttggagccttttt

SEQ ID NO: 846608 - DNA, 20 bp, mouse
gttgatgtatacatatgcag

SEQ ID NO: 846609 - DNA, 20 bp, mouse
gttggtttttttggaaaagg

SEQ ID NO: 846610 - DNA, 20 bp, mouse
gtacatcaatatttgcagat

SEQ ID NO: 846611 - DNA, 20 bp, mouse
gacactacaggagaattttc

SEQ ID NO: 846612 - DNA, 20 bp, mouse
gaaatcatgagtgaaaggaa

SEQ ID NO: 846613 - DNA, 20 bp, mouse
ggagccttttttggtttttt

SEQ ID NO: 846614 - DNA, 20 bp, mouse
gtctatctctgttgttcaac

SEQ ID NO: 846615 - DNA, 20 bp, mouse
gtttccaaaaaaaccaaaaa

SEQ ID NO: 846616 - DNA, 20 bp, mouse
gtgtggagaggtgcactaca

SEQ ID NO: 846617 - DNA, 20 bp, mouse
gacagtaatggactccctga

SEQ ID NO: 846618 - DNA, 20 bp, mouse
ggatttgcactggggataag

SEQ ID NO: 846619 - DNA, 20 bp, mouse
gaatatgctgatttgcactg

SEQ ID NO: 846620 - DNA, 20 bp, mouse
gcatgtctgtatgcagattc

SEQ ID NO: 846621 - DNA, 20 bp, mouse
gtataatctaacaaagtctt

SEQ ID NO: 846622 - DNA, 20 bp, mouse
gggaatagcccaaggatgta

SEQ ID NO: 846623 - DNA, 20 bp, mouse
gctggtgttgtcatcaggtg

SEQ ID NO: 846624 - DNA, 20 bp, mouse
gtgtcatctgtgttgttatt

SEQ ID NO: 846625 - DNA, 20 bp, mouse
gagtacagaatacgtgttga

SEQ ID NO: 846626 - DNA, 20 bp, mouse
gtcaaaaatagtaattctta

SEQ ID NO: 846627 - DNA, 20 bp, mouse
gcatacatgtgtgagccgtc

SEQ ID NO: 846628 - DNA, 20 bp, mouse
gatagaatatgaaggatcat

SEQ ID NO: 846629 - DNA, 20 bp, mouse
gtcatggtcatagaatatga

SEQ ID NO: 846630 - DNA, 20 bp, mouse
gaatcagatgacacattatg

SEQ ID NO: 846631 - DNA, 20 bp, mouse
gcatcaactattaaatagtg

SEQ ID NO: 846632 - DNA, 20 bp, mouse
gattataaactgaataaaaa

SEQ ID NO: 846633 - DNA, 20 bp, mouse
gtgtaacagcacagacctga

SEQ ID NO: 846634 - DNA, 20 bp, mouse
gtaacaacatatatctcatt

SEQ ID NO: 846635 - DNA, 20 bp, mouse
gaaactgaataaaaatggga

SEQ ID NO: 846636 - DNA, 20 bp, mouse
ggctactgaggctaaatcag

SEQ ID NO: 846637 - DNA, 20 bp, mouse
gataatctgaagagctactg

SEQ ID NO: 846638 - DNA, 20 bp, mouse
gtacaacacaatctgtgaat

SEQ ID NO: 846639 - DNA, 20 bp, mouse
gcattaagcgcaagattaca

SEQ ID NO: 846640 - DNA, 20 bp, mouse
gcaagactgtaatttaatac

SEQ ID NO: 846641 - DNA, 20 bp, mouse
ggtattgttacagtacataa

SEQ ID NO: 846642 - DNA, 20 bp, mouse
ggtattatacttgttagtac

SEQ ID NO: 846643 - DNA, 20 bp, mouse
gattgtattcctgagcttta

SEQ ID NO: 846644 - DNA, 20 bp, mouse
gtactggtattttctagtca

SEQ ID NO: 846645 - DNA, 20 bp, mouse
gagaggggtccttaaagctc

SEQ ID NO: 846646 - DNA, 20 bp, mouse
gagatgggatcacagtggtt

SEQ ID NO: 846647 - DNA, 20 bp, mouse
gtaagattggtaaaggcctc

SEQ ID NO: 846648 - DNA, 20 bp, mouse
ggtacatagtattgtaagat

SEQ ID NO: 846649 - DNA, 20 bp, mouse
gagtattgtaagattggtaa

SEQ ID NO: 846650 - DNA, 20 bp, mouse
gctcattggctaaatcagat

SEQ ID NO: 846651 - DNA, 20 bp, mouse
gaccgtagatatattctgaa

SEQ ID NO: 846652 - DNA, 20 bp, mouse
gcatcatgagtagaaattac

SEQ ID NO: 846653 - DNA, 20 bp, mouse
gaaattatgtttgttattag

SEQ ID NO: 846654 - DNA, 20 bp, mouse
gtggtatatttctatagaat

SEQ ID NO: 846655 - DNA, 20 bp, mouse
gaatctgaagagcttctcat

SEQ ID NO: 846656 - DNA, 20 bp, mouse
gcccatccatgcagatcact

SEQ ID NO: 846657 - DNA, 20 bp, mouse
ggggacttcttgattcagaa

SEQ ID NO: 846658 - DNA, 20 bp, mouse
gtctactgtagtcttttcag

SEQ ID NO: 846659 - DNA, 20 bp, mouse
gagtgtcagtgcatggggac

SEQ ID NO: 846660 - DNA, 20 bp, mouse
gtcccagtgatctgcatgga

SEQ ID NO: 846661 - DNA, 20 bp, mouse
gagactacagtagaaatggt

SEQ ID NO: 846662 - DNA, 20 bp, mouse
gtcaataagagaatcagaat

SEQ ID NO: 846663 - DNA, 20 bp, mouse
ggagaaccaatcgcagaaac

SEQ ID NO: 846664 - DNA, 20 bp, mouse
gtctacagtgtcagtgcatg

SEQ ID NO: 846665 - DNA, 20 bp, mouse
gtactgccagtttctgcgat

SEQ ID NO: 846666 - DNA, 20 bp, mouse
gtgtggaaacaactgggaat

SEQ ID NO: 846667 - DNA, 20 bp, mouse
gaagcaggttgtgcttagag

SEQ ID NO: 846668 - DNA, 20 bp, mouse
gccagagctgttcaagtcat

SEQ ID NO: 846669 - DNA, 20 bp, mouse
gggtaaaaaacccctcttgg

SEQ ID NO: 846670 - DNA, 20 bp, mouse
gtcctctagagcccccaaga

SEQ ID NO: 846671 - DNA, 20 bp, mouse
gacatctaagaccatgtaca

SEQ ID NO: 846672 - DNA, 20 bp, mouse
gcacttcacagtggacatga

SEQ ID NO: 846673 - DNA, 20 bp, mouse
gaagatctgtggaaacaact

SEQ ID NO: 846674 - DNA, 20 bp, mouse
ggatcacagaagtcctgtgt

SEQ ID NO: 846675 - DNA, 20 bp, mouse
gtgagccatagaaatgtatt

SEQ ID NO: 846676 - DNA, 20 bp, mouse
gcaagaaaacttcacaacct

SEQ ID NO: 846677 - DNA, 20 bp, mouse
gacctgggcctgtatttagc

SEQ ID NO: 846678 - DNA, 20 bp, mouse
gcatgaacagactcacaaaa

SEQ ID NO: 846679 - DNA, 20 bp, mouse
ggcctgctaaatacaggccc

SEQ ID NO: 846680 - DNA, 20 bp, mouse
gacctcagttgtatacaatg

SEQ ID NO: 846681 - DNA, 20 bp, mouse
gcatataacaaattccaatc

SEQ ID NO: 846682 - DNA, 20 bp, mouse
gacacacatactcaggtcat

SEQ ID NO: 846683 - DNA, 20 bp, mouse
gccctcattgtatacaactg

SEQ ID NO: 846684 - DNA, 20 bp, mouse
gttttacatccagcttttaa

SEQ ID NO: 846685 - DNA, 20 bp, mouse
gtcttagtctacatgatttt

SEQ ID NO: 846686 - DNA, 20 bp, mouse
gttagtaaatagcaaagctt

SEQ ID NO: 846687 - DNA, 20 bp, mouse
gctgaaggatagtgttttac

SEQ ID NO: 846688 - DNA, 20 bp, mouse
gtattggatatgttcactga

SEQ ID NO: 846689 - DNA, 20 bp, mouse
gccatgacaatgtatttcta

SEQ ID NO: 846690 - DNA, 20 bp, mouse
ggaccttcaagatagcaatc

SEQ ID NO: 846691 - DNA, 20 bp, mouse
gctcctgattgctatcttga

SEQ ID NO: 846692 - DNA, 20 bp, mouse
gtatgaacttatggctaacc

SEQ ID NO: 846693 - DNA, 20 bp, mouse
gcaaggtctggttgtcctca

SEQ ID NO: 846694 - DNA, 20 bp, mouse
gtagtttctatgtattgcaa

SEQ ID NO: 846695 - DNA, 20 bp, mouse
gagagcactaatcatttatt

SEQ ID NO: 846696 - DNA, 20 bp, mouse
gcccactgaagaactttcaa

SEQ ID NO: 846697 - DNA, 20 bp, mouse
ggcctttgaaagttcttcag

SEQ ID NO: 846698 - DNA, 20 bp, mouse
gtctgtgtacttctatgtct

SEQ ID NO: 846699 - DNA, 20 bp, mouse
ggtcttggtgactatgatga

SEQ ID NO: 846700 - DNA, 20 bp, mouse
gtactggacaaggaaatgca

SEQ ID NO: 846701 - DNA, 20 bp, mouse
gttaagaataatgtttttac

SEQ ID NO: 846702 - DNA, 20 bp, mouse
gactatttcatgttacctaa

SEQ ID NO: 846703 - DNA, 20 bp, mouse
gataatgtttttactggaca

SEQ ID NO: 846704 - DNA, 20 bp, mouse
ggtctacagagttatttcca

SEQ ID NO: 846705 - DNA, 20 bp, mouse
gaaaacatttatcattttgg

SEQ ID NO: 846706 - DNA, 20 bp, mouse
gttccctgatacttacaatg

SEQ ID NO: 846707 - DNA, 20 bp, mouse
ggatatttgctttaataaag

SEQ ID NO: 846708 - DNA, 20 bp, mouse
ggtccacattgtaagtatca

SEQ ID NO: 846709 - DNA, 20 bp, mouse
gttagacattcttcctcaag

SEQ ID NO: 846710 - DNA, 20 bp, mouse
gtgaagacttatgttttcac

SEQ ID NO: 846711 - DNA, 20 bp, mouse
ggacactgatgttcattttc

SEQ ID NO: 846712 - DNA, 20 bp, mouse
gtcgggagctatttgtgaca

SEQ ID NO: 846713 - DNA, 20 bp, mouse
gtgaacaaacacaataattt

SEQ ID NO: 846714 - DNA, 20 bp, mouse
gtctttccatttaataatag

SEQ ID NO: 846715 - DNA, 20 bp, mouse
gcatatcttaaaacttcttt

SEQ ID NO: 846716 - DNA, 20 bp, mouse
ggatagccagtgcttcataa

SEQ ID NO: 846717 - DNA, 20 bp, mouse
gcatgtggcatcttgcccag

SEQ ID NO: 846718 - DNA, 20 bp, mouse
gtcagtgtacattgtttcat

SEQ ID NO: 846719 - DNA, 20 bp, mouse
gactaaagaaggtttccact

SEQ ID NO: 846720 - DNA, 20 bp, mouse
gagtaagaaatatgaatttg

SEQ ID NO: 846721 - DNA, 20 bp, mouse
gtttgtagggcttttgaaga

SEQ ID NO: 846722 - DNA, 20 bp, mouse
gatcctgggactaactctgt

SEQ ID NO: 846723 - DNA, 20 bp, mouse
gtgctatgttaaaggacatg

SEQ ID NO: 846724 - DNA, 20 bp, mouse
gttattatctaatatttaaa

SEQ ID NO: 846725 - DNA, 20 bp, mouse
gaaaacatgaatcattttgt

SEQ ID NO: 846726 - DNA, 20 bp, mouse
ggtgcattattacataaagt

SEQ ID NO: 846727 - DNA, 20 bp, mouse
gaaaatggcttaatatatag

SEQ ID NO: 846728 - DNA, 20 bp, mouse
gattgtatacaaagttatta

SEQ ID NO: 846729 - DNA, 20 bp, mouse
gacacaatctctttagtgaa

SEQ ID NO: 846730 - DNA, 20 bp, mouse
gctgagtcacagcaggtcta

SEQ ID NO: 846731 - DNA, 20 bp, mouse
gctgtgactcagcagggcat

SEQ ID NO: 846732 - DNA, 20 bp, mouse
ggacctgctgtgactcagca

SEQ ID NO: 846733 - DNA, 20 bp, mouse
gaatctctttagtgaatggt

SEQ ID NO: 846734 - DNA, 20 bp, mouse
gctttattcttattcaacac

SEQ ID NO: 846735 - DNA, 20 bp, mouse
gaccctagtgtagactctat

SEQ ID NO: 846736 - DNA, 20 bp, mouse
ggacactcagtttaatttca

SEQ ID NO: 846737 - DNA, 20 bp, mouse
gtgcgagtagaaagcaacaa

SEQ ID NO: 846738 - DNA, 20 bp, mouse
ggaaaggtcctaatcatgaa

SEQ ID NO: 846739 - DNA, 20 bp, mouse
gctctgtctcttgagtccta

SEQ ID NO: 846740 - DNA, 20 bp, mouse
gttaatgttttctctggatg

SEQ ID NO: 846741 - DNA, 20 bp, mouse
gagataagagtgcatatgtg

SEQ ID NO: 846742 - DNA, 20 bp, mouse
gtaagagtgcatatgtgtgg

SEQ ID NO: 846743 - DNA, 20 bp, mouse
gtgtgtagcaaagactgtcc

SEQ ID NO: 846744 - DNA, 20 bp, mouse
gtatgaatttgtggccaatc

SEQ ID NO: 846745 - DNA, 20 bp, mouse
gttgagtcctaaggtgaaag

SEQ ID NO: 846746 - DNA, 20 bp, mouse
gtctacaggtgactcatgga

SEQ ID NO: 846747 - DNA, 20 bp, mouse
gtctatctacaggtgactca

SEQ ID NO: 846748 - DNA, 20 bp, mouse
gtacaacttttgaacttgat

SEQ ID NO: 846749 - DNA, 20 bp, mouse
gagactatgatgcacagtcc

SEQ ID NO: 846750 - DNA, 20 bp, mouse
gattttttttttggatgacc

SEQ ID NO: 846751 - DNA, 20 bp, mouse
gcatccaaaaaaaaaatcac

SEQ ID NO: 846752 - DNA, 20 bp, mouse
gtagcctgtgattttttttt

SEQ ID NO: 846753 - DNA, 20 bp, mouse
gggctaatcaagaaataata

SEQ ID NO: 846754 - DNA, 20 bp, mouse
gtaacatgtaaaacagtagt

SEQ ID NO: 846755 - DNA, 20 bp, mouse
gaagatatacataaaaactg

SEQ ID NO: 846756 - DNA, 20 bp, mouse
ggaccccaaatcattgtgtt

SEQ ID NO: 846757 - DNA, 20 bp, mouse
ggctttaaatattattcaat

SEQ ID NO: 846758 - DNA, 20 bp, mouse
gaatgaaaatgttaaccatt

SEQ ID NO: 846759 - DNA, 20 bp, mouse
gtaatagcatgtcccccaaa

SEQ ID NO: 846760 - DNA, 20 bp, mouse
gtgtaattcattgcctgtcc

SEQ ID NO: 846761 - DNA, 20 bp, mouse
gattattaaatggaaaagtt

SEQ ID NO: 846762 - DNA, 20 bp, mouse
ggggacatgctattagagaa

SEQ ID NO: 846763 - DNA, 20 bp, mouse
ggaccaaacacaatgatttg

SEQ ID NO: 846764 - DNA, 20 bp, mouse
gaagttatataaatgcaatg

SEQ ID NO: 846765 - DNA, 20 bp, mouse
gagacaaacatataaatttg

SEQ ID NO: 846766 - DNA, 20 bp, mouse
ggtgctgggaatgaatccta

SEQ ID NO: 846767 - DNA, 20 bp, mouse
gagtactgacctgtctggaa

SEQ ID NO: 846768 - DNA, 20 bp, mouse
gagatctaggaggaaaatgt

SEQ ID NO: 846769 - DNA, 20 bp, mouse
gcattcaagttattattttt

SEQ ID NO: 846770 - DNA, 20 bp, mouse
gtgaatcctagggccttact

SEQ ID NO: 846771 - DNA, 20 bp, mouse
ggttaaaaacacatattgat

SEQ ID NO: 846772 - DNA, 20 bp, mouse
ggtgtctccatgcaattgac

SEQ ID NO: 846773 - DNA, 20 bp, mouse
gagtaaatacttgcctagta

SEQ ID NO: 846774 - DNA, 20 bp, mouse
gtgtaatgaggatttcctag

SEQ ID NO: 846775 - DNA, 20 bp, mouse
gaaatcctcattacaaagat

SEQ ID NO: 846776 - DNA, 20 bp, mouse
gggagtgcaccattatatcc

SEQ ID NO: 846777 - DNA, 20 bp, mouse
gtggtgcactccttaatact

SEQ ID NO: 846778 - DNA, 20 bp, mouse
gtatgattctaagcttaatc

SEQ ID NO: 846779 - DNA, 20 bp, mouse
gaagtttttcctggatataa

SEQ ID NO: 846780 - DNA, 20 bp, mouse
gtaaattttaaagtttttcc

SEQ ID NO: 846781 - DNA, 20 bp, mouse
ggaaaattgatcccaaatta

SEQ ID NO: 846782 - DNA, 20 bp, mouse
gttgactaaacaccataatt

SEQ ID NO: 846783 - DNA, 20 bp, mouse
gattttttctttatagaagt

SEQ ID NO: 846784 - DNA, 20 bp, mouse
gtgtatagctatgactgttc

SEQ ID NO: 846785 - DNA, 20 bp, mouse
ggtcttgagtcctagtatta

SEQ ID NO: 846786 - DNA, 20 bp, mouse
gacatgttgggtcatcaaat

SEQ ID NO: 846787 - DNA, 20 bp, mouse
gccaagttcagacacatgtt

SEQ ID NO: 846788 - DNA, 20 bp, mouse
gcaaatgtctggcttatagc

SEQ ID NO: 846789 - DNA, 20 bp, mouse
gtggattacaggagtgaatc

SEQ ID NO: 846790 - DNA, 20 bp, mouse
gatttagaaaaaagcaatag

SEQ ID NO: 846791 - DNA, 20 bp, mouse
ggttttagtagctggattac

SEQ ID NO: 846792 - DNA, 20 bp, mouse
ggttctttatcttatttgat

SEQ ID NO: 846793 - DNA, 20 bp, mouse
gatggcacaataatttactc

SEQ ID NO: 846794 - DNA, 20 bp, mouse
gtaagttgccaagagaaata

SEQ ID NO: 846795 - DNA, 20 bp, mouse
gttttgtgtgttttagtagc

SEQ ID NO: 846796 - DNA, 20 bp, mouse
gcctagaatggagtacccag

SEQ ID NO: 846797 - DNA, 20 bp, mouse
gggtatttcaggttcagatg

SEQ ID NO: 846798 - DNA, 20 bp, mouse
gcaatactttctatcatctg

SEQ ID NO: 846799 - DNA, 20 bp, mouse
gggttcagatgtggtacctc

SEQ ID NO: 846800 - DNA, 20 bp, mouse
gtactgactgacacttcagg

SEQ ID NO: 846801 - DNA, 20 bp, mouse
ggacccaaagacaaaattgc

SEQ ID NO: 846802 - DNA, 20 bp, mouse
gctctcaagatttcctagaa

SEQ ID NO: 846803 - DNA, 20 bp, mouse
gtgatagaaagtattgaagc

SEQ ID NO: 846804 - DNA, 20 bp, mouse
gatatactgactgacacttc

SEQ ID NO: 846805 - DNA, 20 bp, mouse
gagagaaatgtccaacaact

SEQ ID NO: 846806 - DNA, 20 bp, mouse
gatatacttagtgacagctc

SEQ ID NO: 846807 - DNA, 20 bp, mouse
ggttgctaaagtgtcatctc

SEQ ID NO: 846808 - DNA, 20 bp, mouse
gaaaatatagtccattcatt

SEQ ID NO: 846809 - DNA, 20 bp, mouse
gttctctatataacgatatc

SEQ ID NO: 846810 - DNA, 20 bp, mouse
gctctggacataacatagaa

SEQ ID NO: 846811 - DNA, 20 bp, mouse
gtttgaaaaatgatgtttgt

SEQ ID NO: 846812 - DNA, 20 bp, mouse
gtgtacatttctccagtcgg

SEQ ID NO: 846813 - DNA, 20 bp, mouse
gacatttctccagtcggtgg

SEQ ID NO: 846814 - DNA, 20 bp, mouse
ggaagaaggagaagaaaagg

SEQ ID NO: 846815 - DNA, 20 bp, mouse
gagcaaagagaaaaaggtgg

SEQ ID NO: 846816 - DNA, 20 bp, mouse
gcggggacccttcccggaac

SEQ ID NO: 846817 - DNA, 20 bp, mouse
gcctgagggtagaaaagtca

SEQ ID NO: 846818 - DNA, 20 bp, mouse
ggattagcggggacccttcc

SEQ ID NO: 846819 - DNA, 20 bp, mouse
gtgtagcgaaatgtgcacta

SEQ ID NO: 846820 - DNA, 20 bp, mouse
gaatgtgcactatggattag

SEQ ID NO: 846821 - DNA, 20 bp, mouse
gatggaatccagttccggga

SEQ ID NO: 846822 - DNA, 20 bp, mouse
gatgttaaaatcaatagact

SEQ ID NO: 846823 - DNA, 20 bp, mouse
gaagtcttcattgttctgct

SEQ ID NO: 846824 - DNA, 20 bp, mouse
gaataatggaatccagttcc

SEQ ID NO: 846825 - DNA, 20 bp, mouse
gggttctagctctaaagtgc

SEQ ID NO: 846826 - DNA, 20 bp, mouse
gatatactgattgacatctc

SEQ ID NO: 846827 - DNA, 20 bp, mouse
gactttagcaacttactcct

SEQ ID NO: 846828 - DNA, 20 bp, mouse
gtactctatataaacatgtc

SEQ ID NO: 846829 - DNA, 20 bp, mouse
gctctgtacctaacattgaa

SEQ ID NO: 846830 - DNA, 20 bp, mouse
gctttctgcttcagggagtt

SEQ ID NO: 846831 - DNA, 20 bp, mouse
gttctctttgcttcttcttt

SEQ ID NO: 846832 - DNA, 20 bp, mouse
gaagccaaatttgcatgtta

SEQ ID NO: 846833 - DNA, 20 bp, mouse
gacagaagaaagaggaggaa

SEQ ID NO: 846834 - DNA, 20 bp, mouse
gctgcttcagggagtttggg

SEQ ID NO: 846835 - DNA, 20 bp, mouse
ggcaaatttggctttcacat

SEQ ID NO: 846836 - DNA, 20 bp, mouse
gcttggaaggtagagttaat

SEQ ID NO: 846837 - DNA, 20 bp, mouse
gctctggacctaagattgaa

SEQ ID NO: 846838 - DNA, 20 bp, mouse
ggttgataaagtgtcgtctc

SEQ ID NO: 846839 - DNA, 20 bp, mouse
gtcctgaattctgttatgtc

SEQ ID NO: 846840 - DNA, 20 bp, mouse
gtaacagaattcaggatgtt

SEQ ID NO: 846841 - DNA, 20 bp, mouse
gagaattcaggatgtttggg

SEQ ID NO: 846842 - DNA, 20 bp, mouse
gggattcttgaccatcttac

SEQ ID NO: 846843 - DNA, 20 bp, mouse
gacatttcttcattaggtga

SEQ ID NO: 846844 - DNA, 20 bp, mouse
gttaattctatcctgtaaga

SEQ ID NO: 846845 - DNA, 20 bp, mouse
gttctgttatgtcaggcaga

SEQ ID NO: 846846 - DNA, 20 bp, mouse
gaggacagtactgtccttca

SEQ ID NO: 846847 - DNA, 20 bp, mouse
ggacacaatgcatactttga

SEQ ID NO: 846848 - DNA, 20 bp, mouse
ggggattatttattctagtc

SEQ ID NO: 846849 - DNA, 20 bp, mouse
gtaaattgagacttatgtat

SEQ ID NO: 846850 - DNA, 20 bp, mouse
gttatttattctagtcagga

SEQ ID NO: 846851 - DNA, 20 bp, mouse
gcatttatgcaactttttat

SEQ ID NO: 846852 - DNA, 20 bp, mouse
gcatatataatcatattatg

SEQ ID NO: 846853 - DNA, 20 bp, mouse
gaattttcagaaaatcaaac

SEQ ID NO: 846854 - DNA, 20 bp, mouse
gtcatattatgaggaatgat

SEQ ID NO: 846855 - DNA, 20 bp, mouse
gcaaaataagaggaattcag

SEQ ID NO: 846856 - DNA, 20 bp, mouse
gagaagaaatgcaaagacat

SEQ ID NO: 846857 - DNA, 20 bp, mouse
gatgcacatacacgtgacaa

SEQ ID NO: 846858 - DNA, 20 bp, mouse
ggacatagggggacaggtca

SEQ ID NO: 846859 - DNA, 20 bp, mouse
ggctacctgatggacatagg

SEQ ID NO: 846860 - DNA, 20 bp, mouse
ggactggtcatcttagatga

SEQ ID NO: 846861 - DNA, 20 bp, mouse
gctgtccccctatgtccatc

SEQ ID NO: 846862 - DNA, 20 bp, mouse
gtgggacaaacgtgtgtcct

SEQ ID NO: 846863 - DNA, 20 bp, mouse
gcatctaaaatgaagcatca

SEQ ID NO: 846864 - DNA, 20 bp, mouse
gtcatcttagatgatggcca

SEQ ID NO: 846865 - DNA, 20 bp, mouse
gcgtgtatgtgcatgttttc

SEQ ID NO: 846866 - DNA, 20 bp, mouse
gacaatgctacagcagtgac

SEQ ID NO: 846867 - DNA, 20 bp, mouse
gggctgataaatatagatca

SEQ ID NO: 846868 - DNA, 20 bp, mouse
gaggtttatcacatgcatgg

SEQ ID NO: 846869 - DNA, 20 bp, mouse
gcatgagtccttcctgaagg

SEQ ID NO: 846870 - DNA, 20 bp, mouse
gaatcatgagtccttcctga

SEQ ID NO: 846871 - DNA, 20 bp, mouse
gaggctgcttttcactgaca

SEQ ID NO: 846872 - DNA, 20 bp, mouse
gagagcatttgatgtccact

SEQ ID NO: 846873 - DNA, 20 bp, mouse
gagttgatccaccttcagga

SEQ ID NO: 846874 - DNA, 20 bp, mouse
gatcaaatgctctaaacttg

SEQ ID NO: 846875 - DNA, 20 bp, mouse
gtttgatttgctgatttgtg

SEQ ID NO: 846876 - DNA, 20 bp, mouse
ggaactgtgaatataataca

SEQ ID NO: 846877 - DNA, 20 bp, mouse
gcagaatttcctatgtatct

SEQ ID NO: 846878 - DNA, 20 bp, mouse
gaggctctacatctgaggtc

SEQ ID NO: 846879 - DNA, 20 bp, mouse
gactgtgacaaaagtttaaa

SEQ ID NO: 846880 - DNA, 20 bp, mouse
gtcattatgtacgaacacag

SEQ ID NO: 846881 - DNA, 20 bp, mouse
gactcaacatctgagtgata

SEQ ID NO: 846882 - DNA, 20 bp, mouse
gggtctggtatgagctatgc

SEQ ID NO: 846883 - DNA, 20 bp, mouse
gcataggaaattctggcctc

SEQ ID NO: 846884 - DNA, 20 bp, mouse
gatgcacatgaatgcagtca

SEQ ID NO: 846885 - DNA, 20 bp, mouse
gggcagtctcacatgcaaca

SEQ ID NO: 846886 - DNA, 20 bp, mouse
gagtgacaagccaagtccac

SEQ ID NO: 846887 - DNA, 20 bp, mouse
gttgttctcaaagggttact

SEQ ID NO: 846888 - DNA, 20 bp, mouse
gttctgaagtttgttctcaa

SEQ ID NO: 846889 - DNA, 20 bp, mouse
gcacttgcaatttgtggatc

SEQ ID NO: 846890 - DNA, 20 bp, mouse
ggcaatttgtggatctggac

SEQ ID NO: 846891 - DNA, 20 bp, mouse
ggtgtgtgtcccagtggact

SEQ ID NO: 846892 - DNA, 20 bp, mouse
ggtgaagcgccttgattgag

SEQ ID NO: 846893 - DNA, 20 bp, mouse
gccatggtcttcaaaggtaa

SEQ ID NO: 846894 - DNA, 20 bp, mouse
ggactcaattctaaacaaga

SEQ ID NO: 846895 - DNA, 20 bp, mouse
gcatcataaagtatcaaaag

SEQ ID NO: 846896 - DNA, 20 bp, mouse
gcattctatctcacactccc

SEQ ID NO: 846897 - DNA, 20 bp, mouse
ggagtgtgagatagaatgaa

SEQ ID NO: 846898 - DNA, 20 bp, mouse
gcaggataatattatccctg

SEQ ID NO: 846899 - DNA, 20 bp, mouse
gccttccctacactataaaa

SEQ ID NO: 846900 - DNA, 20 bp, mouse
gtcttccattttatagtgta

SEQ ID NO: 846901 - DNA, 20 bp, mouse
gtcaacaccttgctcaatac

SEQ ID NO: 846902 - DNA, 20 bp, mouse
gtaacatccagtattgagca

SEQ ID NO: 846903 - DNA, 20 bp, mouse
gaatattatcctggagagct

SEQ ID NO: 846904 - DNA, 20 bp, mouse
gctcaactcttgacttatta

SEQ ID NO: 846905 - DNA, 20 bp, mouse
gcatgacataattctcccca

SEQ ID NO: 846906 - DNA, 20 bp, mouse
gactcatcagcagactccat

SEQ ID NO: 846907 - DNA, 20 bp, mouse
gaaactgagcatttatgtac

SEQ ID NO: 846908 - DNA, 20 bp, mouse
gatagtttaaaaattctcag

SEQ ID NO: 846909 - DNA, 20 bp, mouse
ggttagttggacacctgtga

SEQ ID NO: 846910 - DNA, 20 bp, mouse
gcacctgtgatggaaactgt

SEQ ID NO: 846911 - DNA, 20 bp, mouse
gattgtatcaactgtcttgg

SEQ ID NO: 846912 - DNA, 20 bp, mouse
gcatattgtatcaactgtct

SEQ ID NO: 846913 - DNA, 20 bp, mouse
gcagttgatacaatatgcat

SEQ ID NO: 846914 - DNA, 20 bp, mouse
gatacaatatgcattggtat

SEQ ID NO: 846915 - DNA, 20 bp, mouse
gaaataacaagtgtgaatta

SEQ ID NO: 846916 - DNA, 20 bp, mouse
gaggcattgagaatgacatt

SEQ ID NO: 846917 - DNA, 20 bp, mouse
gtccccacaggctccatcac

SEQ ID NO: 846918 - DNA, 20 bp, mouse
gtgttcagtacatatatgtt

SEQ ID NO: 846919 - DNA, 20 bp, mouse
gccacaggctccatcacagg

SEQ ID NO: 846920 - DNA, 20 bp, mouse
gggaggccaagcaactgaaa

SEQ ID NO: 846921 - DNA, 20 bp, mouse
gaactaacaagtaagaactt

SEQ ID NO: 846922 - DNA, 20 bp, mouse
gactaaaaataaagcaatgc

SEQ ID NO: 846923 - DNA, 20 bp, mouse
gtgttttttaacttgaatat

SEQ ID NO: 846924 - DNA, 20 bp, mouse
ggttgcttggcctcctgtga

SEQ ID NO: 846925 - DNA, 20 bp, mouse
ggagcttagggttgatctct

SEQ ID NO: 846926 - DNA, 20 bp, mouse
gctgaagtcatagtgccctt

SEQ ID NO: 846927 - DNA, 20 bp, mouse
gtacatatatgcttcgttca

SEQ ID NO: 846928 - DNA, 20 bp, mouse
gctaaaaacaacagaagctc

SEQ ID NO: 846929 - DNA, 20 bp, mouse
gtccccataggttacataac

SEQ ID NO: 846930 - DNA, 20 bp, mouse
gactcctgttatgtaaccta

SEQ ID NO: 846931 - DNA, 20 bp, mouse
gttttaatatgaatcaatat

SEQ ID NO: 846932 - DNA, 20 bp, mouse
gatattcatcactagccaaa

SEQ ID NO: 846933 - DNA, 20 bp, mouse
gcacattgcataaaacatct

SEQ ID NO: 846934 - DNA, 20 bp, mouse
gatccaacaagtgtgaacta

SEQ ID NO: 846935 - DNA, 20 bp, mouse
gtcccatagttcacacttgt

SEQ ID NO: 846936 - DNA, 20 bp, mouse
gtacaaacacgaaaagctca

SEQ ID NO: 846937 - DNA, 20 bp, mouse
gctcctgtggtggaacctgt

SEQ ID NO: 846938 - DNA, 20 bp, mouse
gtccccacaggttccaccac

SEQ ID NO: 846939 - DNA, 20 bp, mouse
ggttacttggactcctgtgg

SEQ ID NO: 846940 - DNA, 20 bp, mouse
gttgagtggttacgccagca

SEQ ID NO: 846941 - DNA, 20 bp, mouse
gatacaatatgcattggttt

SEQ ID NO: 846942 - DNA, 20 bp, mouse
gaaccaacaagtgtgaacta

SEQ ID NO: 846943 - DNA, 20 bp, mouse
gtcccatagttcacacttgt

SEQ ID NO: 846944 - DNA, 20 bp, mouse
ggaaaatatttattttcaca

SEQ ID NO: 846945 - DNA, 20 bp, mouse
ggctaaaaagaaatccctgc

SEQ ID NO: 846946 - DNA, 20 bp, mouse
gagcctcagcagcagtctga

SEQ ID NO: 846947 - DNA, 20 bp, mouse
ggtcacacaaatcactctaa

SEQ ID NO: 846948 - DNA, 20 bp, mouse
gagctgtaatgtaaacagtg

SEQ ID NO: 846949 - DNA, 20 bp, mouse
gcaactaagtgaaaagaata

SEQ ID NO: 846950 - DNA, 20 bp, mouse
ggtataacaactcaaaatta

SEQ ID NO: 846951 - DNA, 20 bp, mouse
gttccttcagactgctgctg

SEQ ID NO: 846952 - DNA, 20 bp, mouse
gagctgacaagtgtgagtta

SEQ ID NO: 846953 - DNA, 20 bp, mouse
gttacaatatgcattgatgt

SEQ ID NO: 846954 - DNA, 20 bp, mouse
gtacaaacagcaagaactct

SEQ ID NO: 846955 - DNA, 20 bp, mouse
gagggattaaaaatgtcatt

SEQ ID NO: 846956 - DNA, 20 bp, mouse
gaactcctcttgggatgatt

SEQ ID NO: 846957 - DNA, 20 bp, mouse
gttaggtacgaactcctctt

SEQ ID NO: 846958 - DNA, 20 bp, mouse
gaacctgtaggaaacactca

SEQ ID NO: 846959 - DNA, 20 bp, mouse
gtgtcacaataataattcaa

SEQ ID NO: 846960 - DNA, 20 bp, mouse
gcatgtaagtttaatgaatg

SEQ ID NO: 846961 - DNA, 20 bp, mouse
gctcctctcacgtaacctgt

SEQ ID NO: 846962 - DNA, 20 bp, mouse
gattcaagtaaaaaacaacc

SEQ ID NO: 846963 - DNA, 20 bp, mouse
gttcctacaggttacgtgag

SEQ ID NO: 846964 - DNA, 20 bp, mouse
gggctgttggcattttttta

SEQ ID NO: 846965 - DNA, 20 bp, mouse
gaatcataatgcctttggct

SEQ ID NO: 846966 - DNA, 20 bp, mouse
gtgacacactaattattccc

SEQ ID NO: 846967 - DNA, 20 bp, mouse
gggaagtaatagaaaagcct

SEQ ID NO: 846968 - DNA, 20 bp, mouse
gctacaaatagctacagatc

SEQ ID NO: 846969 - DNA, 20 bp, mouse
gtcagggttgaaattgtctt

SEQ ID NO: 846970 - DNA, 20 bp, mouse
gaaattcccaatgccagggg

SEQ ID NO: 846971 - DNA, 20 bp, mouse
gtggctgaaatagtgccttg

SEQ ID NO: 846972 - DNA, 20 bp, mouse
ggtaaagttcaaagtaccca

SEQ ID NO: 846973 - DNA, 20 bp, mouse
gtacttcctcccctggcatt

SEQ ID NO: 846974 - DNA, 20 bp, mouse
gctgtagctatttgtagctt

SEQ ID NO: 846975 - DNA, 20 bp, mouse
ggtcacatttttgtgaccat

SEQ ID NO: 846976 - DNA, 20 bp, mouse
gcctcagcagcagagttcaa

SEQ ID NO: 846977 - DNA, 20 bp, mouse
gtttgacacaaatattccaa

SEQ ID NO: 846978 - DNA, 20 bp, mouse
gtacaaataacactagctta

SEQ ID NO: 846979 - DNA, 20 bp, mouse
ggaactaagcatatttttac

SEQ ID NO: 846980 - DNA, 20 bp, mouse
gccacagtttgcataagatt

SEQ ID NO: 846981 - DNA, 20 bp, mouse
gaatggcatttctgaaccct

SEQ ID NO: 846982 - DNA, 20 bp, mouse
gattgtttttcacttcatta

SEQ ID NO: 846983 - DNA, 20 bp, mouse
ggcatattgtgtaaactgat

SEQ ID NO: 846984 - DNA, 20 bp, mouse
gattgtgtaaactgattgga

SEQ ID NO: 846985 - DNA, 20 bp, mouse
gtatattacagagatttagg

SEQ ID NO: 846986 - DNA, 20 bp, mouse
gcagctgaggccctctatac

SEQ ID NO: 846987 - DNA, 20 bp, mouse
ggcctcagctgcagagccca

SEQ ID NO: 846988 - DNA, 20 bp, mouse
gcattccatggtttttctgt

SEQ ID NO: 846989 - DNA, 20 bp, mouse
gtcaactttgttgaggagtg

SEQ ID NO: 846990 - DNA, 20 bp, mouse
gcatattttcaactttgttg

SEQ ID NO: 846991 - DNA, 20 bp, mouse
ggtgctaatccacatatgta

SEQ ID NO: 846992 - DNA, 20 bp, mouse
ggaattgcaggactgttggt

SEQ ID NO: 846993 - DNA, 20 bp, mouse
gtagtgaattgcaggactgt

SEQ ID NO: 846994 - DNA, 20 bp, mouse
gctgttggtcggtcccactt

SEQ ID NO: 846995 - DNA, 20 bp, mouse
ggcccaaaagaatgcattgc

SEQ ID NO: 846996 - DNA, 20 bp, mouse
gttccaatagaaggcaagta

SEQ ID NO: 846997 - DNA, 20 bp, mouse
gctcttgggctctacagctg

SEQ ID NO: 846998 - DNA, 20 bp, mouse
gggaggtcaactcttatctt

SEQ ID NO: 846999 - DNA, 20 bp, mouse
gttgcgcctttactagtcaa

SEQ ID NO: 847000 - DNA, 20 bp, mouse
gtttttaaacaatttctctt

SEQ ID NO: 847001 - DNA, 20 bp, mouse
gggaaaggaacaatatgtaa

SEQ ID NO: 847002 - DNA, 20 bp, mouse
gctttggctatttgtaacat

SEQ ID NO: 847003 - DNA, 20 bp, mouse
gtggctaaaattatgaagca

SEQ ID NO: 847004 - DNA, 20 bp, mouse
gcattgcctttgactagtaa

SEQ ID NO: 847005 - DNA, 20 bp, mouse
gggtcatgtttttatgacca

SEQ ID NO: 847006 - DNA, 20 bp, mouse
gaatcatggcacctgaggat

SEQ ID NO: 847007 - DNA, 20 bp, mouse
gacatatggcggttaacaca

SEQ ID NO: 847008 - DNA, 20 bp, mouse
gtcatttatatcatgctccc

SEQ ID NO: 847009 - DNA, 20 bp, mouse
ggttctgatgaaatccattg

SEQ ID NO: 847010 - DNA, 20 bp, mouse
ggactttgagttgaatcatg

SEQ ID NO: 847011 - DNA, 20 bp, mouse
gatgatataaatgaatggaa

SEQ ID NO: 847012 - DNA, 20 bp, mouse
ggccatatgtataaccacaa

SEQ ID NO: 847013 - DNA, 20 bp, mouse
gtggcggttaacacatggtc

SEQ ID NO: 847014 - DNA, 20 bp, mouse
gtcttccattgtctaatgta

SEQ ID NO: 847015 - DNA, 20 bp, mouse
gcttcccaggggcaataccc

SEQ ID NO: 847016 - DNA, 20 bp, mouse
ggtgaaggaggcaacagaaa

SEQ ID NO: 847017 - DNA, 20 bp, mouse
gctaatctctggctatttgt

SEQ ID NO: 847018 - DNA, 20 bp, mouse
ggtctcagctgtagagctca

SEQ ID NO: 847019 - DNA, 20 bp, mouse
gtgtagagctcaagggaaat

SEQ ID NO: 847020 - DNA, 20 bp, mouse
gggaggtcaaccctaatctc

SEQ ID NO: 847021 - DNA, 20 bp, mouse
gggaggcaacagaaaaggtt

SEQ ID NO: 847022 - DNA, 20 bp, mouse
gttcccaattgaagtgaagg

SEQ ID NO: 847023 - DNA, 20 bp, mouse
gatgagcaaacttttatcct

SEQ ID NO: 847024 - DNA, 20 bp, mouse
gttgcctccttcacttcaat

SEQ ID NO: 847025 - DNA, 20 bp, mouse
gttactagccaaaggcacta

SEQ ID NO: 847026 - DNA, 20 bp, mouse
gtatggacagtgctacagca

SEQ ID NO: 847027 - DNA, 20 bp, mouse
gacagtgctacagcagggac

SEQ ID NO: 847028 - DNA, 20 bp, mouse
ggtccatactacattctcag

SEQ ID NO: 847029 - DNA, 20 bp, mouse
ggtccactgagaatgtagta

SEQ ID NO: 847030 - DNA, 20 bp, mouse
ggaaggactcgtgaagtctg

SEQ ID NO: 847031 - DNA, 20 bp, mouse
gcacgagtccttcccgaagg

SEQ ID NO: 847032 - DNA, 20 bp, mouse
ggcatatattagtacctgtt

SEQ ID NO: 847033 - DNA, 20 bp, mouse
gagttgctccaccttcggga

SEQ ID NO: 847034 - DNA, 20 bp, mouse
gcttcacgagtccttcccga

SEQ ID NO: 847035 - DNA, 20 bp, mouse
gttgttagttgctccacctt

SEQ ID NO: 847036 - DNA, 20 bp, mouse
gtgggaccaaattttcaaag

SEQ ID NO: 847037 - DNA, 20 bp, mouse
gtccatactgcattctcagt

SEQ ID NO: 847038 - DNA, 20 bp, mouse
ggtgtcaaaatctccaaaga

SEQ ID NO: 847039 - DNA, 20 bp, mouse
gtgagaatgcagtatggaca

SEQ ID NO: 847040 - DNA, 20 bp, mouse
gacccactgagaatgcagta

SEQ ID NO: 847041 - DNA, 20 bp, mouse
ggaggctgattttccttctt

SEQ ID NO: 847042 - DNA, 20 bp, mouse
gatagtacatggggatctat

SEQ ID NO: 847043 - DNA, 20 bp, mouse
gatcaaatgctctaaacatg

SEQ ID NO: 847044 - DNA, 20 bp, mouse
gcttgatttcctgatccgtt

SEQ ID NO: 847045 - DNA, 20 bp, mouse
gagattccactttgaaaatt

SEQ ID NO: 847046 - DNA, 20 bp, mouse
gtgagaatgcagtatggaca

SEQ ID NO: 847047 - DNA, 20 bp, mouse
ggaggctgatttttcttctc

SEQ ID NO: 847048 - DNA, 20 bp, mouse
gatccactgagaatgcagta

SEQ ID NO: 847049 - DNA, 20 bp, mouse
gttaaggaaattaaggttcc

SEQ ID NO: 847050 - DNA, 20 bp, mouse
gatagtacatggggatctat

SEQ ID NO: 847051 - DNA, 20 bp, mouse
gtcatggtggatcaactcaa

SEQ ID NO: 847052 - DNA, 20 bp, mouse
gatcaaatgctctaaacatg

SEQ ID NO: 847053 - DNA, 20 bp, mouse
gcttgatttcctgatccgtt

SEQ ID NO: 847054 - DNA, 20 bp, mouse
gatgcatttatggttcagga

SEQ ID NO: 847055 - DNA, 20 bp, mouse
gaccataaatgcatgtctca

SEQ ID NO: 847056 - DNA, 20 bp, mouse
gatcaaagggtctaaacatg

SEQ ID NO: 847057 - DNA, 20 bp, mouse
ggttcacaaatcttcagaga

SEQ ID NO: 847058 - DNA, 20 bp, mouse
gatccactgagaatgctgta

SEQ ID NO: 847059 - DNA, 20 bp, mouse
gattctcagtggatatcaaa

SEQ ID NO: 847060 - DNA, 20 bp, mouse
ggtccatacagcattctcag

SEQ ID NO: 847061 - DNA, 20 bp, mouse
gtctgaagatttgtgaacaa

SEQ ID NO: 847062 - DNA, 20 bp, mouse
gcacagtgttaatagtgcat

SEQ ID NO: 847063 - DNA, 20 bp, mouse
gatagtgcatggggatatat

SEQ ID NO: 847064 - DNA, 20 bp, mouse
gtcatggtggatcaactcaa

SEQ ID NO: 847065 - DNA, 20 bp, mouse
gatgcatttatggttcagga

SEQ ID NO: 847066 - DNA, 20 bp, mouse
gcaaaaggatctctcctctg

SEQ ID NO: 847067 - DNA, 20 bp, mouse
gctctggagtggtctggtct

SEQ ID NO: 847068 - DNA, 20 bp, mouse
gttgtaccaaactctcaaga

SEQ ID NO: 847069 - DNA, 20 bp, mouse
ggctgtagaacctgaggcca

SEQ ID NO: 847070 - DNA, 20 bp, mouse
gcctggcttgagttcctcag

SEQ ID NO: 847071 - DNA, 20 bp, mouse
gtctatccctcttgagagtt

SEQ ID NO: 847072 - DNA, 20 bp, mouse
gttgagagtttggtacaaac

SEQ ID NO: 847073 - DNA, 20 bp, mouse
gtgaatgctctggagtggtc

SEQ ID NO: 847074 - DNA, 20 bp, mouse
gatcatgcttgtggctgaag

SEQ ID NO: 847075 - DNA, 20 bp, mouse
gtagaaaataccctggcctc

SEQ ID NO: 847076 - DNA, 20 bp, mouse
gaactcttgtcttactaagg

SEQ ID NO: 847077 - DNA, 20 bp, mouse
gtgacatgcagcactgagga

SEQ ID NO: 847078 - DNA, 20 bp, mouse
gggatacattggaaaatttc

SEQ ID NO: 847079 - DNA, 20 bp, mouse
gcattgtctagtgtagaaaa

SEQ ID NO: 847080 - DNA, 20 bp, mouse
gtctatcgtgtttacacata

SEQ ID NO: 847081 - DNA, 20 bp, mouse
gagtctgacatgcagcactg

SEQ ID NO: 847082 - DNA, 20 bp, mouse
ggaatgatatggaatattta

SEQ ID NO: 847083 - DNA, 20 bp, mouse
gaatgaaatcatggcaccgg

SEQ ID NO: 847084 - DNA, 20 bp, mouse
gaaatcatggcaccggagga

SEQ ID NO: 847085 - DNA, 20 bp, mouse
gtatggctgttgacatggtc

SEQ ID NO: 847086 - DNA, 20 bp, mouse
gcctgaggttcatccctgtt

SEQ ID NO: 847087 - DNA, 20 bp, mouse
gcacagggatcgactcaact

SEQ ID NO: 847088 - DNA, 20 bp, mouse
gcctcagatgtgaaacctga

SEQ ID NO: 847089 - DNA, 20 bp, mouse
gcatctgaggtaccctgcac

SEQ ID NO: 847090 - DNA, 20 bp, mouse
gaacctgagggtagaaattt

SEQ ID NO: 847091 - DNA, 20 bp, mouse
gcgactcaacttggatagat

SEQ ID NO: 847092 - DNA, 20 bp, mouse
gtcagtgactcaaatcaagt

SEQ ID NO: 847093 - DNA, 20 bp, mouse
gctccaaaatttctaccctc

SEQ ID NO: 847094 - DNA, 20 bp, mouse
gcatgatgtgatgattttgt

SEQ ID NO: 847095 - DNA, 20 bp, mouse
ggatttatcatcaccctaac

SEQ ID NO: 847096 - DNA, 20 bp, mouse
gtcctgtgattcctgccatg

SEQ ID NO: 847097 - DNA, 20 bp, mouse
ggacatgttctccacatggc

SEQ ID NO: 847098 - DNA, 20 bp, mouse
gcaggctccctagatacaaa

SEQ ID NO: 847099 - DNA, 20 bp, mouse
gtccacatggcaggaatcac

SEQ ID NO: 847100 - DNA, 20 bp, mouse
gaggaatcacaggaagtttg

SEQ ID NO: 847101 - DNA, 20 bp, mouse
gagatacaaaaggaaaattc

SEQ ID NO: 847102 - DNA, 20 bp, mouse
gagagagcatggtcaactac

SEQ ID NO: 847103 - DNA, 20 bp, mouse
gactgtgatagaagttgaga

SEQ ID NO: 847104 - DNA, 20 bp, mouse
gtaacacattgtctaattta

SEQ ID NO: 847105 - DNA, 20 bp, mouse
gggtcagctctgagctatgc

SEQ ID NO: 847106 - DNA, 20 bp, mouse
gggcactatgacttcagcaa

SEQ ID NO: 847107 - DNA, 20 bp, mouse
gcgtattcttcactactcta

SEQ ID NO: 847108 - DNA, 20 bp, mouse
ggaggccaactaagtagaaa

SEQ ID NO: 847109 - DNA, 20 bp, mouse
gatagtttcaaaattcccag

SEQ ID NO: 847110 - DNA, 20 bp, mouse
gaactaacaagtgtgaattc

SEQ ID NO: 847111 - DNA, 20 bp, mouse
ggcaatttattaactttgag

SEQ ID NO: 847112 - DNA, 20 bp, mouse
gacagacaacaagagctcag

SEQ ID NO: 847113 - DNA, 20 bp, mouse
gaaggtattgagaatgccac

SEQ ID NO: 847114 - DNA, 20 bp, mouse
gttagtatgaaaacaattta

SEQ ID NO: 847115 - DNA, 20 bp, mouse
gataaaatatgcatttgtgt

SEQ ID NO: 847116 - DNA, 20 bp, mouse
gtgacatgcagcattgagga

SEQ ID NO: 847117 - DNA, 20 bp, mouse
gagtctgacatgcagcattg

SEQ ID NO: 847118 - DNA, 20 bp, mouse
gtgtttgtctgcacaaaaaa

SEQ ID NO: 847119 - DNA, 20 bp, mouse
gaaatcatggcaccttagga

SEQ ID NO: 847120 - DNA, 20 bp, mouse
gaatgaaatcatggcacctt

SEQ ID NO: 847121 - DNA, 20 bp, mouse
gcattcaatgtcattctccc

SEQ ID NO: 847122 - DNA, 20 bp, mouse
gcttcccaggggcaataccc

SEQ ID NO: 847123 - DNA, 20 bp, mouse
gctctccagggtattgcccc

SEQ ID NO: 847124 - DNA, 20 bp, mouse
gcattctccctggatacatt

SEQ ID NO: 847125 - DNA, 20 bp, mouse
gtgacattgaatgaatagaa

SEQ ID NO: 847126 - DNA, 20 bp, mouse
gcattctatgtcgtactccc

SEQ ID NO: 847127 - DNA, 20 bp, mouse
gcatgacatacttattccca

SEQ ID NO: 847128 - DNA, 20 bp, mouse
ggatttcatcataactttca

SEQ ID NO: 847129 - DNA, 20 bp, mouse
gatagagaatgctcaacacc

SEQ ID NO: 847130 - DNA, 20 bp, mouse
ggacattgcagcattgagcc

SEQ ID NO: 847131 - DNA, 20 bp, mouse
gcccagggataatattctcc

SEQ ID NO: 847132 - DNA, 20 bp, mouse
gcgtactccctggatacatt

SEQ ID NO: 847133 - DNA, 20 bp, mouse
gattgttgactataactaag

SEQ ID NO: 847134 - DNA, 20 bp, mouse
ggagtacgacatagaatgaa

SEQ ID NO: 847135 - DNA, 20 bp, mouse
gaatattctcctggacagct

SEQ ID NO: 847136 - DNA, 20 bp, mouse
gcttcccagggataatcttc

SEQ ID NO: 847137 - DNA, 20 bp, mouse
gtttccagaagattatccct

SEQ ID NO: 847138 - DNA, 20 bp, mouse
gtgacatgcaggattgactc

SEQ ID NO: 847139 - DNA, 20 bp, mouse
ggataatcttctggaaagct

SEQ ID NO: 847140 - DNA, 20 bp, mouse
gtcttccactgtccagtgta

SEQ ID NO: 847141 - DNA, 20 bp, mouse
ggaagggcagtctgacatgc

SEQ ID NO: 847142 - DNA, 20 bp, mouse
gccttccctacactggacag

SEQ ID NO: 847143 - DNA, 20 bp, mouse
gacttttgaatataattagg

SEQ ID NO: 847144 - DNA, 20 bp, mouse
gtggatacatcaggaaattc

SEQ ID NO: 847145 - DNA, 20 bp, mouse
ggccatatgtataaacacga

SEQ ID NO: 847146 - DNA, 20 bp, mouse
gttgcatggcacagaatgag

SEQ ID NO: 847147 - DNA, 20 bp, mouse
gtggcacagaatgagtggaa

SEQ ID NO: 847148 - DNA, 20 bp, mouse
gagtctggcccacgctgctc

SEQ ID NO: 847149 - DNA, 20 bp, mouse
gcattctgtgccatgcaacc

SEQ ID NO: 847150 - DNA, 20 bp, mouse
gcatgcaacctggaaacatc

SEQ ID NO: 847151 - DNA, 20 bp, mouse
gtcttccatggtctagtcta

SEQ ID NO: 847152 - DNA, 20 bp, mouse
gatggatatgaacaaaatta

SEQ ID NO: 847153 - DNA, 20 bp, mouse
gactgtagaatgtacttaag

SEQ ID NO: 847154 - DNA, 20 bp, mouse
gccttccctagactagacca

SEQ ID NO: 847155 - DNA, 20 bp, mouse
gagactttaaggtgaatcat

SEQ ID NO: 847156 - DNA, 20 bp, mouse
gggtctggcccaagctgttc

SEQ ID NO: 847157 - DNA, 20 bp, mouse
gacctcagatgcagagctcg

SEQ ID NO: 847158 - DNA, 20 bp, mouse
gagccttgcaatggacatat

SEQ ID NO: 847159 - DNA, 20 bp, mouse
gaatgtagaaaataattgag

SEQ ID NO: 847160 - DNA, 20 bp, mouse
gtcgtgaaaacatgttgtaa

SEQ ID NO: 847161 - DNA, 20 bp, mouse
gcacctatatgtccattgca

SEQ ID NO: 847162 - DNA, 20 bp, mouse
gagatacagctgttgatatg

SEQ ID NO: 847163 - DNA, 20 bp, mouse
gttgcaaggctattattgtc

SEQ ID NO: 847164 - DNA, 20 bp, mouse
gggtcatgttcaccatcctc

SEQ ID NO: 847165 - DNA, 20 bp, mouse
gatcttatcctgaacagctt

SEQ ID NO: 847166 - DNA, 20 bp, mouse
gacaaatcatgggtgaaatc

SEQ ID NO: 847167 - DNA, 20 bp, mouse
gagtcactaaggtattatct

SEQ ID NO: 847168 - DNA, 20 bp, mouse
ggaaagatggccaggcagct

SEQ ID NO: 847169 - DNA, 20 bp, mouse
gataatcatatgtcacagag

SEQ ID NO: 847170 - DNA, 20 bp, mouse
gtcattacaaaattatggat

SEQ ID NO: 847171 - DNA, 20 bp, mouse
gattttttgtagacattatt

SEQ ID NO: 847172 - DNA, 20 bp, mouse
gtatcaaagcttttccttag

SEQ ID NO: 847173 - DNA, 20 bp, mouse
gggaaatctttaccaaattc

SEQ ID NO: 847174 - DNA, 20 bp, mouse
gttcagtgtacctagctgcc

SEQ ID NO: 847175 - DNA, 20 bp, mouse
ggaataaatataagcaaact

SEQ ID NO: 847176 - DNA, 20 bp, mouse
ggcaaagcagattgtactcc

SEQ ID NO: 847177 - DNA, 20 bp, mouse
gctccaagggctcaggaacc

SEQ ID NO: 847178 - DNA, 20 bp, mouse
gagtaatcctgattgttggc

SEQ ID NO: 847179 - DNA, 20 bp, mouse
gacctagtaatcctgattgt

SEQ ID NO: 847180 - DNA, 20 bp, mouse
gatcaggattactaggtgcc

SEQ ID NO: 847181 - DNA, 20 bp, mouse
gagtttgttgatgtgttatt

SEQ ID NO: 847182 - DNA, 20 bp, mouse
gtgttttcctgccaacaatc

SEQ ID NO: 847183 - DNA, 20 bp, mouse
gtctgaaagatgacatcaaa

SEQ ID NO: 847184 - DNA, 20 bp, mouse
gaacaaactgataaaacatg

SEQ ID NO: 847185 - DNA, 20 bp, mouse
gacatcaaagggttcagtgg

SEQ ID NO: 847186 - DNA, 20 bp, mouse
gaagacaacgcctaaaatct

SEQ ID NO: 847187 - DNA, 20 bp, mouse
ggcggcagaacccagatttt

SEQ ID NO: 847188 - DNA, 20 bp, mouse
gaccaatatactaataaaag

SEQ ID NO: 847189 - DNA, 20 bp, mouse
ggccgcttttattagtatat

SEQ ID NO: 847190 - DNA, 20 bp, mouse
gtattagtatattggtaaga

SEQ ID NO: 847191 - DNA, 20 bp, mouse
gggagtagcaatcggctcac

SEQ ID NO: 847192 - DNA, 20 bp, mouse
gaagcttgacaatgacaaac

SEQ ID NO: 847193 - DNA, 20 bp, mouse
gctgcagtcttctttactca

SEQ ID NO: 847194 - DNA, 20 bp, mouse
gttgacaatgacaaacagga

SEQ ID NO: 847195 - DNA, 20 bp, mouse
gcttgcttcttttgatatag

SEQ ID NO: 847196 - DNA, 20 bp, mouse
gggagtgtttggatactaga

SEQ ID NO: 847197 - DNA, 20 bp, mouse
gaaacactccctcaattcct

SEQ ID NO: 847198 - DNA, 20 bp, mouse
gatactagagggcctgtacc

SEQ ID NO: 847199 - DNA, 20 bp, mouse
gtgcgaagcgcacacaatct

SEQ ID NO: 847200 - DNA, 20 bp, mouse
gataaagcattgttttgtcc

SEQ ID NO: 847201 - DNA, 20 bp, mouse
gattatactcccaggaattg

SEQ ID NO: 847202 - DNA, 20 bp, mouse
gctgagaatcaggattccct

SEQ ID NO: 847203 - DNA, 20 bp, mouse
gaagagagactaaccagtag

SEQ ID NO: 847204 - DNA, 20 bp, mouse
gcatagtgtacatacccgac

SEQ ID NO: 847205 - DNA, 20 bp, mouse
ggccattcccctcgcaatca

SEQ ID NO: 847206 - DNA, 20 bp, mouse
gggagtgtttggatactaga

SEQ ID NO: 847207 - DNA, 20 bp, mouse
gaaacactccctcaattcct

SEQ ID NO: 847208 - DNA, 20 bp, mouse
gatactagagggcctgtacc

SEQ ID NO: 847209 - DNA, 20 bp, mouse
gtgcgaagcgcacacaatct

SEQ ID NO: 847210 - DNA, 20 bp, mouse
gataaagcattgttttgtcc

SEQ ID NO: 847211 - DNA, 20 bp, mouse
gattatactcccaggaattg

SEQ ID NO: 847212 - DNA, 20 bp, mouse
gctgagaatcaggattccct

SEQ ID NO: 847213 - DNA, 20 bp, mouse
gaagagagactaaccagtag

SEQ ID NO: 847214 - DNA, 20 bp, mouse
gcatagtgtacatacccgac

SEQ ID NO: 847215 - DNA, 20 bp, mouse
ggccattcccctcgcaatca

SEQ ID NO: 847216 - DNA, 20 bp, mouse
ggcccttcccctcacaatca

SEQ ID NO: 847217 - DNA, 20 bp, mouse
gcatagtgtacatactccac

SEQ ID NO: 847218 - DNA, 20 bp, mouse
ggagactcatagtgattctg

SEQ ID NO: 847219 - DNA, 20 bp, mouse
gactcatagtgattctgtgg

SEQ ID NO: 847220 - DNA, 20 bp, mouse
gctccatgattgtgagggga

SEQ ID NO: 847221 - DNA, 20 bp, mouse
gaagagagactaacccatag

SEQ ID NO: 847222 - DNA, 20 bp, mouse
gcaaaggagattatactcgc

SEQ ID NO: 847223 - DNA, 20 bp, mouse
gcaggaatcacttggcacca

SEQ ID NO: 847224 - DNA, 20 bp, mouse
gaaggactccatgattgtga

SEQ ID NO: 847225 - DNA, 20 bp, mouse
ggactgaatagtgcctctat

SEQ ID NO: 847226 - DNA, 20 bp, mouse
gcaaagcagattatattcac

SEQ ID NO: 847227 - DNA, 20 bp, mouse
gttctggtcctggtccatgt

SEQ ID NO: 847228 - DNA, 20 bp, mouse
gcatctgaagccagcaacaa

SEQ ID NO: 847229 - DNA, 20 bp, mouse
gtgtttgagggcaaaaggtt

SEQ ID NO: 847230 - DNA, 20 bp, mouse
ggtgaatacagattctcagc

SEQ ID NO: 847231 - DNA, 20 bp, mouse
ggagatctgttaagattctt

SEQ ID NO: 847232 - DNA, 20 bp, mouse
gagtttgttgacgtgctatt

SEQ ID NO: 847233 - DNA, 20 bp, mouse
gacactgagtcctttgttgc

SEQ ID NO: 847234 - DNA, 20 bp, mouse
gtgacttaatatttttccac

SEQ ID NO: 847235 - DNA, 20 bp, mouse
gtttataaacttgacccaca

SEQ ID NO: 847236 - DNA, 20 bp, mouse
gcaaagtagactatactcca

SEQ ID NO: 847237 - DNA, 20 bp, mouse
gtgtggttgtctggtcagta

SEQ ID NO: 847238 - DNA, 20 bp, mouse
gggtaaagtgaggctagcca

SEQ ID NO: 847239 - DNA, 20 bp, mouse
gaaggtcccaaggtaaagtg

SEQ ID NO: 847240 - DNA, 20 bp, mouse
gggaagcatcaaaggtgaaa

SEQ ID NO: 847241 - DNA, 20 bp, mouse
ggacttaattgtgctttccc

SEQ ID NO: 847242 - DNA, 20 bp, mouse
ggtttggatactggtgggca

SEQ ID NO: 847243 - DNA, 20 bp, mouse
gcatcaaaggtgaaaagggc

SEQ ID NO: 847244 - DNA, 20 bp, mouse
gtaccccacaggtgttttgg

SEQ ID NO: 847245 - DNA, 20 bp, mouse
gagcacaattaagtcatgaa

SEQ ID NO: 847246 - DNA, 20 bp, mouse
gggtggtggggtggcaggga

SEQ ID NO: 847247 - DNA, 20 bp, mouse
gaaacactccctctgttcgc

SEQ ID NO: 847248 - DNA, 20 bp, mouse
gttatactccagcgaacaga

SEQ ID NO: 847249 - DNA, 20 bp, mouse
ggggactcacagtgactatg

SEQ ID NO: 847250 - DNA, 20 bp, mouse
gctcacagtgactatgtgga

SEQ ID NO: 847251 - DNA, 20 bp, mouse
ggggacttctcagtgcccca

SEQ ID NO: 847252 - DNA, 20 bp, mouse
ggtctggtcagtgtagatca

SEQ ID NO: 847253 - DNA, 20 bp, mouse
gtaccccacaggtattttag

SEQ ID NO: 847254 - DNA, 20 bp, mouse
gtttggagcatggtggtggt

SEQ ID NO: 847255 - DNA, 20 bp, mouse
gttagtctctctttaccttg

SEQ ID NO: 847256 - DNA, 20 bp, mouse
gggtggtggggtggcaggga

SEQ ID NO: 847257 - DNA, 20 bp, mouse
gaaacactccctcagttcgc

SEQ ID NO: 847258 - DNA, 20 bp, mouse
ggtaatgaagggttatctga

SEQ ID NO: 847259 - DNA, 20 bp, mouse
ggggactcacagtgactatg

SEQ ID NO: 847260 - DNA, 20 bp, mouse
gctcacagtgactatgtgga

SEQ ID NO: 847261 - DNA, 20 bp, mouse
ggtctggtcagtgtagatca

SEQ ID NO: 847262 - DNA, 20 bp, mouse
ggggacttctcagtgcccca

SEQ ID NO: 847263 - DNA, 20 bp, mouse
gtaccccacaggtattttag

SEQ ID NO: 847264 - DNA, 20 bp, mouse
gctcaactgaacagatatct

SEQ ID NO: 847265 - DNA, 20 bp, mouse
gtttggagcatggtggtggt

SEQ ID NO: 847266 - DNA, 20 bp, mouse
ggaaggggacacaatctagt

SEQ ID NO: 847267 - DNA, 20 bp, mouse
gtgacaggttcatgattcct

SEQ ID NO: 847268 - DNA, 20 bp, mouse
ggggaattctgggtctcggc

SEQ ID NO: 847269 - DNA, 20 bp, mouse
gactcacagcaactctgtga

SEQ ID NO: 847270 - DNA, 20 bp, mouse
gactgggcacctgggaattc

SEQ ID NO: 847271 - DNA, 20 bp, mouse
gagtaagctgaggattctca

SEQ ID NO: 847272 - DNA, 20 bp, mouse
gtgtttgagggcaaaaaggc

SEQ ID NO: 847273 - DNA, 20 bp, mouse
gcttaactgaacagttatct

SEQ ID NO: 847274 - DNA, 20 bp, mouse
ggaacctgtcactgggcacc

SEQ ID NO: 847275 - DNA, 20 bp, mouse
gaacataataatgtcatgat

SEQ ID NO: 847276 - DNA, 20 bp, mouse
gcaggagctgcaatcaggtt

SEQ ID NO: 847277 - DNA, 20 bp, mouse
gtacagggctgaagtgacac

SEQ ID NO: 847278 - DNA, 20 bp, mouse
gtgagcaatcctctcagacg

SEQ ID NO: 847279 - DNA, 20 bp, mouse
gcaaagcctacaggataagc

SEQ ID NO: 847280 - DNA, 20 bp, mouse
gtacgacatgaactttagtc

SEQ ID NO: 847281 - DNA, 20 bp, mouse
gttagtcaggagctgcaatc

SEQ ID NO: 847282 - DNA, 20 bp, mouse
gtgcaatcagttgcaatttc

SEQ ID NO: 847283 - DNA, 20 bp, mouse
gtggactttgtgtgcatttc

SEQ ID NO: 847284 - DNA, 20 bp, mouse
gcaatttctggatctggaaa

SEQ ID NO: 847285 - DNA, 20 bp, mouse
gtgaaagttattttacgtta

SEQ ID NO: 847286 - DNA, 20 bp, mouse
ggagctggagtacctatact

SEQ ID NO: 847287 - DNA, 20 bp, mouse
ggtatgatttcagatagagc

SEQ ID NO: 847288 - DNA, 20 bp, mouse
gaaccaaatttgaaaaaaag

SEQ ID NO: 847289 - DNA, 20 bp, mouse
gaggggggggtttccttcca

SEQ ID NO: 847290 - DNA, 20 bp, mouse
gaggaggataattcattctt

SEQ ID NO: 847291 - DNA, 20 bp, mouse
ggggctgtggataccagttg

SEQ ID NO: 847292 - DNA, 20 bp, mouse
gcaaaacatgtgtgatacaa

SEQ ID NO: 847293 - DNA, 20 bp, mouse
gttccctggggctccccaac

SEQ ID NO: 847294 - DNA, 20 bp, mouse
gtaccagttggggagcccca

SEQ ID NO: 847295 - DNA, 20 bp, mouse
gaaactgcatctgcatgact

SEQ ID NO: 847296 - DNA, 20 bp, mouse
gagggaggggggtccttcca

SEQ ID NO: 847297 - DNA, 20 bp, mouse
ggagctggagtacctatact

SEQ ID NO: 847298 - DNA, 20 bp, mouse
ggtatgatttcagatagagc

SEQ ID NO: 847299 - DNA, 20 bp, mouse
ggtgtaggtaaatagttagg

SEQ ID NO: 847300 - DNA, 20 bp, mouse
gcaaatttgaaaaaaaggga

SEQ ID NO: 847301 - DNA, 20 bp, mouse
gatttgaaaaaaagggaggg

SEQ ID NO: 847302 - DNA, 20 bp, mouse
ggggctgtggataccagttg

SEQ ID NO: 847303 - DNA, 20 bp, mouse
gcaaaacatgtgtgatacaa

SEQ ID NO: 847304 - DNA, 20 bp, mouse
gttccctggggctccccaac

SEQ ID NO: 847305 - DNA, 20 bp, mouse
gaggaggataattcattctt

SEQ ID NO: 847306 - DNA, 20 bp, mouse
ggggtgttaagaggaatgtt

SEQ ID NO: 847307 - DNA, 20 bp, mouse
gttatcattgcaaagtatac

SEQ ID NO: 847308 - DNA, 20 bp, mouse
gtctctgaactttattctaa

SEQ ID NO: 847309 - DNA, 20 bp, mouse
gtacagatgtggctccacag

SEQ ID NO: 847310 - DNA, 20 bp, mouse
gcacagtcacatgcaattta

SEQ ID NO: 847311 - DNA, 20 bp, mouse
ggcagaaattgctacagatg

SEQ ID NO: 847312 - DNA, 20 bp, mouse
gttattctaagggtgttaag

SEQ ID NO: 847313 - DNA, 20 bp, mouse
gtgtttggaaacgagtagac

SEQ ID NO: 847314 - DNA, 20 bp, mouse
gctgccagtgccaaacgaga

SEQ ID NO: 847315 - DNA, 20 bp, mouse
gagtgaggcctagcaagcat

SEQ ID NO: 847316 - DNA, 20 bp, mouse
ggagctggagtacctaaact

SEQ ID NO: 847317 - DNA, 20 bp, mouse
gcagatcaaattccaagttt

SEQ ID NO: 847318 - DNA, 20 bp, mouse
ggtatgatttcagatagagc

SEQ ID NO: 847319 - DNA, 20 bp, mouse
gaaccaaatttgaaaaaaaa

SEQ ID NO: 847320 - DNA, 20 bp, mouse
gaggggggggtttccttcca

SEQ ID NO: 847321 - DNA, 20 bp, mouse
gaggaggataattcattctt

SEQ ID NO: 847322 - DNA, 20 bp, mouse
ggggctgtggataccagttg

SEQ ID NO: 847323 - DNA, 20 bp, mouse
gcaaaacatgtgtgatacaa

SEQ ID NO: 847324 - DNA, 20 bp, mouse
gttccctggggctccccaac

SEQ ID NO: 847325 - DNA, 20 bp, mouse
gaaactgcatctgcatgact

SEQ ID NO: 847326 - DNA, 20 bp, mouse
gaccaatattctattaaaaa

SEQ ID NO: 847327 - DNA, 20 bp, mouse
gatggcagaacacggatttt

SEQ ID NO: 847328 - DNA, 20 bp, mouse
ggccatttttaatagaatat

SEQ ID NO: 847329 - DNA, 20 bp, mouse
gtattaaaaatggcagaaca

SEQ ID NO: 847330 - DNA, 20 bp, mouse
gtaatagaatattggtaaga

SEQ ID NO: 847331 - DNA, 20 bp, mouse
gggagtagcaaacggatcac

SEQ ID NO: 847332 - DNA, 20 bp, mouse
ggaataatgacagaagcatg

SEQ ID NO: 847333 - DNA, 20 bp, mouse
gaggaagagtaaaggtatca

SEQ ID NO: 847334 - DNA, 20 bp, mouse
gattgcttcttttgatattt

SEQ ID NO: 847335 - DNA, 20 bp, mouse
gcacttgataatcttgacaa

SEQ ID NO: 847336 - DNA, 20 bp, mouse
gaagaattcctccagggctc

SEQ ID NO: 847337 - DNA, 20 bp, mouse
gcaaagtctaagtcagggat

SEQ ID NO: 847338 - DNA, 20 bp, mouse
gcaattagaaattatatgag

SEQ ID NO: 847339 - DNA, 20 bp, mouse
gatgtttttgaacacttaga

SEQ ID NO: 847340 - DNA, 20 bp, mouse
gggatctaatttggatgcac

SEQ ID NO: 847341 - DNA, 20 bp, mouse
gttttaaaaattttccaagc

SEQ ID NO: 847342 - DNA, 20 bp, mouse
gtgactacagaaataaatga

SEQ ID NO: 847343 - DNA, 20 bp, mouse
ggattgctcctgagccctgg

SEQ ID NO: 847344 - DNA, 20 bp, mouse
gtaccctggggttctgcaat

SEQ ID NO: 847345 - DNA, 20 bp, mouse
gcatagaataatatattctt

SEQ ID NO: 847346 - DNA, 20 bp, mouse
gtcttctgaaactctctctt

SEQ ID NO: 847347 - DNA, 20 bp, mouse
gcctacctccgtcttttaag

SEQ ID NO: 847348 - DNA, 20 bp, mouse
ggagagaaggaagtatatat

SEQ ID NO: 847349 - DNA, 20 bp, mouse
ggacggaggtaggcagacag

SEQ ID NO: 847350 - DNA, 20 bp, mouse
gagaaggaagtatatatggg

SEQ ID NO: 847351 - DNA, 20 bp, mouse
gtaaaagagagggtgcatat

SEQ ID NO: 847352 - DNA, 20 bp, mouse
gaagtggtggattaaacaag

SEQ ID NO: 847353 - DNA, 20 bp, mouse
gtaatccaccacttaaaaga

SEQ ID NO: 847354 - DNA, 20 bp, mouse
gacctccgtcttttaagtgg

SEQ ID NO: 847355 - DNA, 20 bp, mouse
ggtgacttgttgagtaattt

SEQ ID NO: 847356 - DNA, 20 bp, mouse
gagacagtaaccaaagagaa

SEQ ID NO: 847357 - DNA, 20 bp, mouse
gatgtctgagtcatgtcctg

SEQ ID NO: 847358 - DNA, 20 bp, mouse
ggaagtgaaatgttgccccc

SEQ ID NO: 847359 - DNA, 20 bp, mouse
ggactcagacattgcatgta

SEQ ID NO: 847360 - DNA, 20 bp, mouse
ggaaactcttcctttctctt

SEQ ID NO: 847361 - DNA, 20 bp, mouse
gaaaggaagagtttcagaac

SEQ ID NO: 847362 - DNA, 20 bp, mouse
gagtagtgggattaaacaag

SEQ ID NO: 847363 - DNA, 20 bp, mouse
ggaagagtttcagaacagga

SEQ ID NO: 847364 - DNA, 20 bp, mouse
gccactactcaggaggaaga

SEQ ID NO: 847365 - DNA, 20 bp, mouse
gagtctatgtagctagtcca

SEQ ID NO: 847366 - DNA, 20 bp, mouse
ggactcagacactgcatgta

SEQ ID NO: 847367 - DNA, 20 bp, mouse
gtgtctgagtcatgtcctga

SEQ ID NO: 847368 - DNA, 20 bp, mouse
ggaagtgaaatgttgccttc

SEQ ID NO: 847369 - DNA, 20 bp, mouse
ggacagtaaccaaagggaga

SEQ ID NO: 847370 - DNA, 20 bp, mouse
gggagagtttcagaacagga

SEQ ID NO: 847371 - DNA, 20 bp, mouse
gagaaggagagtttcagaac

SEQ ID NO: 847372 - DNA, 20 bp, mouse
gagtggtgggattaaacaag

SEQ ID NO: 847373 - DNA, 20 bp, mouse
gccaccactcaggaggaaga

SEQ ID NO: 847374 - DNA, 20 bp, mouse
gagtctatgtagctagtcca

SEQ ID NO: 847375 - DNA, 20 bp, mouse
gcacatttcagaagagtcaa

SEQ ID NO: 847376 - DNA, 20 bp, mouse
gagtctacatagctggaccc

SEQ ID NO: 847377 - DNA, 20 bp, mouse
ggatgaaaataagtgccaga

SEQ ID NO: 847378 - DNA, 20 bp, mouse
gaaagcacagtctacatagc

SEQ ID NO: 847379 - DNA, 20 bp, mouse
gcagagatcttctttctgag

SEQ ID NO: 847380 - DNA, 20 bp, mouse
gctatcacatgagctttgtt

SEQ ID NO: 847381 - DNA, 20 bp, mouse
gctatggttggttacaatta

SEQ ID NO: 847382 - DNA, 20 bp, mouse
gatctctgtataagtatttg

SEQ ID NO: 847383 - DNA, 20 bp, mouse
gtgcctgagtcatgtcttga

SEQ ID NO: 847384 - DNA, 20 bp, mouse
gagctctttcccataccttc

SEQ ID NO: 847385 - DNA, 20 bp, mouse
gtgccttcaagacatgactc

SEQ ID NO: 847386 - DNA, 20 bp, mouse
gcaaggaacaatttcctcat

SEQ ID NO: 847387 - DNA, 20 bp, mouse
gcactcatgagcgaaataag

SEQ ID NO: 847388 - DNA, 20 bp, mouse
ggcccagcagttttatatat

SEQ ID NO: 847389 - DNA, 20 bp, mouse
gttgccagagtaggtgaact

SEQ ID NO: 847390 - DNA, 20 bp, mouse
gaaacttgctgtttctgatt

SEQ ID NO: 847391 - DNA, 20 bp, mouse
gcaagaaaacagacagctca

SEQ ID NO: 847392 - DNA, 20 bp, mouse
gcacacttcctactgacgat

SEQ ID NO: 847393 - DNA, 20 bp, mouse
gttagatacctatcgtcagt

SEQ ID NO: 847394 - DNA, 20 bp, mouse
ggagtaggtgaactaggaga

SEQ ID NO: 847395 - DNA, 20 bp, mouse
gggtgaactaggagaaggca

SEQ ID NO: 847396 - DNA, 20 bp, mouse
gctactactgcaatctctga

SEQ ID NO: 847397 - DNA, 20 bp, mouse
gattgcagtagtagataaat

SEQ ID NO: 847398 - DNA, 20 bp, mouse
gttggccaaacaacacagtc

SEQ ID NO: 847399 - DNA, 20 bp, mouse
ggagacaagaaaaagtaaat

SEQ ID NO: 847400 - DNA, 20 bp, mouse
gacttcctgactgtgttgtt

SEQ ID NO: 847401 - DNA, 20 bp, mouse
gacaagaaaaagtaaatagg

SEQ ID NO: 847402 - DNA, 20 bp, mouse
gcacaatcaaatgacaactt

SEQ ID NO: 847403 - DNA, 20 bp, mouse
gttgtttttaagcagaacgc

SEQ ID NO: 847404 - DNA, 20 bp, mouse
gaactaaatatatacttact

SEQ ID NO: 847405 - DNA, 20 bp, mouse
gtgtcctgaaaaaaacgtgt

SEQ ID NO: 847406 - DNA, 20 bp, mouse
gatagccaatgatgcagagt

SEQ ID NO: 847407 - DNA, 20 bp, mouse
gtatacctactctgcatcat

SEQ ID NO: 847408 - DNA, 20 bp, mouse
gaaagtatcaacttcctcat

SEQ ID NO: 847409 - DNA, 20 bp, mouse
gaatgtccatgcttatgcac

SEQ ID NO: 847410 - DNA, 20 bp, mouse
gtcttttgtttgtaatagct

SEQ ID NO: 847411 - DNA, 20 bp, mouse
gtttatcctgtgcataagca

SEQ ID NO: 847412 - DNA, 20 bp, mouse
ggagacaagaaacagtaaat

SEQ ID NO: 847413 - DNA, 20 bp, mouse
gtagaactctttcttccctt

SEQ ID NO: 847414 - DNA, 20 bp, mouse
gacaaacaaaagacaacttt

SEQ ID NO: 847415 - DNA, 20 bp, mouse
gaacaagtcaggaaatgttt

SEQ ID NO: 847416 - DNA, 20 bp, mouse
gtgagcaacactcttagaag

SEQ ID NO: 847417 - DNA, 20 bp, mouse
gtacagatgtgacaccacag

SEQ ID NO: 847418 - DNA, 20 bp, mouse
gttctctgaactttattctt

SEQ ID NO: 847419 - DNA, 20 bp, mouse
gtgtttggaaacaagtagac

SEQ ID NO: 847420 - DNA, 20 bp, mouse
gtattcttagggtgttaaga

SEQ ID NO: 847421 - DNA, 20 bp, mouse
gtgcagtcacttgcaattta

SEQ ID NO: 847422 - DNA, 20 bp, mouse
ggggtgttaagaaggatgtt

SEQ ID NO: 847423 - DNA, 20 bp, mouse
gttatctttgcaaaacatac

SEQ ID NO: 847424 - DNA, 20 bp, mouse
ggaatcacgatacattgacc

SEQ ID NO: 847425 - DNA, 20 bp, mouse
ggattttgtgcaagtcagga

SEQ ID NO: 847426 - DNA, 20 bp, mouse
gccacaactctcattgatag

SEQ ID NO: 847427 - DNA, 20 bp, mouse
gtatacctattgggcgtcat

SEQ ID NO: 847428 - DNA, 20 bp, mouse
gcaactctcattgatagtgg

SEQ ID NO: 847429 - DNA, 20 bp, mouse
ggagacaagaaacagtaact

SEQ ID NO: 847430 - DNA, 20 bp, mouse
gggaaatcatggtccctcag

SEQ ID NO: 847431 - DNA, 20 bp, mouse
gatatccaatgacgcccaat

SEQ ID NO: 847432 - DNA, 20 bp, mouse
gctactattgcaacctctga

SEQ ID NO: 847433 - DNA, 20 bp, mouse
ggtccattctcatgattcac

SEQ ID NO: 847434 - DNA, 20 bp, mouse
gttgaatcttctctagccag

SEQ ID NO: 847435 - DNA, 20 bp, mouse
gtagtaaagaattttgacta

SEQ ID NO: 847436 - DNA, 20 bp, mouse
gtctaccattgcaacttctg

SEQ ID NO: 847437 - DNA, 20 bp, mouse
gactccctcagaagttgcaa

SEQ ID NO: 847438 - DNA, 20 bp, mouse
gggatcttctattctagcca

SEQ ID NO: 847439 - DNA, 20 bp, mouse
gtatgtatccatcagtccta

SEQ ID NO: 847440 - DNA, 20 bp, mouse
ggctgaaatcatggtacccc

SEQ ID NO: 847441 - DNA, 20 bp, mouse
gataggatcaaattgcagac

SEQ ID NO: 847442 - DNA, 20 bp, mouse
gtttcagccaagaagacaat

SEQ ID NO: 847443 - DNA, 20 bp, mouse
ggtcttttaataaacaattt

SEQ ID NO: 847444 - DNA, 20 bp, mouse
gatcctgtacatgactagca

SEQ ID NO: 847445 - DNA, 20 bp, mouse
gtaataaacaatttgggcta

SEQ ID NO: 847446 - DNA, 20 bp, mouse
gcacacttcctactgacaat

SEQ ID NO: 847447 - DNA, 20 bp, mouse
gttagatacctattgtcagt

SEQ ID NO: 847448 - DNA, 20 bp, mouse
ggcagtgcctaagggaattc

SEQ ID NO: 847449 - DNA, 20 bp, mouse
gcataggttgccagagtagg

SEQ ID NO: 847450 - DNA, 20 bp, mouse
gtaggaacaacttcctgatt

SEQ ID NO: 847451 - DNA, 20 bp, mouse
gtgttctgcttgaaaacaaa

SEQ ID NO: 847452 - DNA, 20 bp, mouse
ggttgccagagtaggtggca

SEQ ID NO: 847453 - DNA, 20 bp, mouse
gatttccatgccacctactc

SEQ ID NO: 847454 - DNA, 20 bp, mouse
ggtcactaggaacttgagaa

SEQ ID NO: 847455 - DNA, 20 bp, mouse
gctagagctgtctgtcttct

SEQ ID NO: 847456 - DNA, 20 bp, mouse
ggacatcaatatatacctgc

SEQ ID NO: 847457 - DNA, 20 bp, mouse
gaaagatctaataatccagc

SEQ ID NO: 847458 - DNA, 20 bp, mouse
gaaacttgctgtttctgagt

SEQ ID NO: 847459 - DNA, 20 bp, mouse
gcacttattttactcatgag

SEQ ID NO: 847460 - DNA, 20 bp, mouse
gcacacttcctactgacgat

SEQ ID NO: 847461 - DNA, 20 bp, mouse
gttagatacctatcgtcagt

SEQ ID NO: 847462 - DNA, 20 bp, mouse
gtggccaaaacagaccaatc

SEQ ID NO: 847463 - DNA, 20 bp, mouse
ggagtaggtgaactagaaga

SEQ ID NO: 847464 - DNA, 20 bp, mouse
gggtgaactagaagaaggca

SEQ ID NO: 847465 - DNA, 20 bp, mouse
ggtcaataggaacttgagaa

SEQ ID NO: 847466 - DNA, 20 bp, mouse
ggtgttcaggtgacaatcat

SEQ ID NO: 847467 - DNA, 20 bp, mouse
ggatgaaatcatcagatgta

SEQ ID NO: 847468 - DNA, 20 bp, mouse
gtattcgaatgtctgtgttc

SEQ ID NO: 847469 - DNA, 20 bp, mouse
gctacagcacattgatactt

SEQ ID NO: 847470 - DNA, 20 bp, mouse
gacattcgaatagagagccc

SEQ ID NO: 847471 - DNA, 20 bp, mouse
ggaaatcatcagatgtaggg

SEQ ID NO: 847472 - DNA, 20 bp, mouse
gttaagcactttctatccca

SEQ ID NO: 847473 - DNA, 20 bp, mouse
ggaaaaacatgtatgaactt

SEQ ID NO: 847474 - DNA, 20 bp, mouse
gaagtgcagtatgactcctt

SEQ ID NO: 847475 - DNA, 20 bp, mouse
gcacattgatacttgggctt

SEQ ID NO: 847476 - DNA, 20 bp, mouse
gaaaacgtggtttgattaac

SEQ ID NO: 847477 - DNA, 20 bp, mouse
gtatgttcacataacaaata

SEQ ID NO: 847478 - DNA, 20 bp, mouse
ggttcacataacaaataagg

SEQ ID NO: 847479 - DNA, 20 bp, mouse
gctgtaagtgcaagggacac

SEQ ID NO: 847480 - DNA, 20 bp, mouse
gattgagttcagttggacat

SEQ ID NO: 847481 - DNA, 20 bp, mouse
gcaaattgtcatcaaaaacg

SEQ ID NO: 847482 - DNA, 20 bp, mouse
gttaatcactgtaagtgcaa

SEQ ID NO: 847483 - DNA, 20 bp, mouse
gaagtgcaagggacacaggc

SEQ ID NO: 847484 - DNA, 20 bp, mouse
gttactgtacctactattaa

SEQ ID NO: 847485 - DNA, 20 bp, mouse
gacatttgtcctttaatagt

SEQ ID NO: 847486 - DNA, 20 bp, mouse
gtgagggatatggatgtaaa

SEQ ID NO: 847487 - DNA, 20 bp, mouse
gataaatagtatcacatgga

SEQ ID NO: 847488 - DNA, 20 bp, mouse
gagtaataaatagtatcaca

SEQ ID NO: 847489 - DNA, 20 bp, mouse
gcatatgcttcattttgttc

SEQ ID NO: 847490 - DNA, 20 bp, mouse
gttgtcatttaaaaaaaaac

SEQ ID NO: 847491 - DNA, 20 bp, mouse
ggacatggatgtaatcatga

SEQ ID NO: 847492 - DNA, 20 bp, mouse
ggttagaaaatttgcacaag

SEQ ID NO: 847493 - DNA, 20 bp, mouse
gtgagttcagttggagtcaa

SEQ ID NO: 847494 - DNA, 20 bp, mouse
gtcattcatttctactgaca

SEQ ID NO: 847495 - DNA, 20 bp, mouse
gatttgaagcaaagctcatt

SEQ ID NO: 847496 - DNA, 20 bp, mouse
ggaatcctgcctgatgttca

SEQ ID NO: 847497 - DNA, 20 bp, mouse
gaacggataatcatgaacaa

SEQ ID NO: 847498 - DNA, 20 bp, mouse
gaaatgctggtgacatatat

SEQ ID NO: 847499 - DNA, 20 bp, mouse
gggtcatcagaaaactgttt

SEQ ID NO: 847500 - DNA, 20 bp, mouse
gaaaactgttttggtgaact

SEQ ID NO: 847501 - DNA, 20 bp, mouse
gtgttcaagtgacaaataag

SEQ ID NO: 847502 - DNA, 20 bp, mouse
gataagggatatagaagaaa

SEQ ID NO: 847503 - DNA, 20 bp, mouse
gtcagttctacgtttgcctc

SEQ ID NO: 847504 - DNA, 20 bp, mouse
gttaatactgagttcaattg

SEQ ID NO: 847505 - DNA, 20 bp, mouse
ggagttcaattgaggtcact

SEQ ID NO: 847506 - DNA, 20 bp, mouse
gggagtgcattagtggtcac

SEQ ID NO: 847507 - DNA, 20 bp, mouse
gcattagtggtcacaggagt

SEQ ID NO: 847508 - DNA, 20 bp, mouse
ggaccactaatgcactccca

SEQ ID NO: 847509 - DNA, 20 bp, mouse
ggtcacaggagtaggctcat

SEQ ID NO: 847510 - DNA, 20 bp, mouse
gagaggtgattaggccacaa

SEQ ID NO: 847511 - DNA, 20 bp, mouse
gcatgaggtcagagccattg

SEQ ID NO: 847512 - DNA, 20 bp, mouse
gatgaatggatcattaccat

SEQ ID NO: 847513 - DNA, 20 bp, mouse
gatatattgtgcagtctata

SEQ ID NO: 847514 - DNA, 20 bp, mouse
gggcaaatggaaaaaaaact

SEQ ID NO: 847515 - DNA, 20 bp, mouse
gaggcaaaaatgttgagaag

SEQ ID NO: 847516 - DNA, 20 bp, mouse
ggtgtttaagaatactccag

SEQ ID NO: 847517 - DNA, 20 bp, mouse
gaggttcatgtttactaata

SEQ ID NO: 847518 - DNA, 20 bp, mouse
gagtaataaatactggtatc

SEQ ID NO: 847519 - DNA, 20 bp, mouse
gataaatactggtatctgga

SEQ ID NO: 847520 - DNA, 20 bp, mouse
gttaataactgcaagtgcta

SEQ ID NO: 847521 - DNA, 20 bp, mouse
gtgagtccatttgaagtctt

SEQ ID NO: 847522 - DNA, 20 bp, mouse
gagttaactcaaattacatt

SEQ ID NO: 847523 - DNA, 20 bp, mouse
gtaatcataagggatatgga

SEQ ID NO: 847524 - DNA, 20 bp, mouse
gaaaagaggaattgtgcctg

SEQ ID NO: 847525 - DNA, 20 bp, mouse
gctataccaaagacttcaaa

SEQ ID NO: 847526 - DNA, 20 bp, mouse
gtatttttttacctgaacat

SEQ ID NO: 847527 - DNA, 20 bp, mouse
gtaagtgctgggacacatac

SEQ ID NO: 847528 - DNA, 20 bp, mouse
gggcaaacatagaactgaaa

SEQ ID NO: 847529 - DNA, 20 bp, mouse
gataagggatatagacaaaa

SEQ ID NO: 847530 - DNA, 20 bp, mouse
gagtaataaatagtggtttc

SEQ ID NO: 847531 - DNA, 20 bp, mouse
gtcagttctatgtttgcctc

SEQ ID NO: 847532 - DNA, 20 bp, mouse
gtgaggtcactttgagttac

SEQ ID NO: 847533 - DNA, 20 bp, mouse
gctgatgtaatctgaattaa

SEQ ID NO: 847534 - DNA, 20 bp, mouse
gttactgtactcactactaa

SEQ ID NO: 847535 - DNA, 20 bp, mouse
gttattactgagttcaattg

SEQ ID NO: 847536 - DNA, 20 bp, mouse
ggatgtaacaataagtgata

SEQ ID NO: 847537 - DNA, 20 bp, mouse
gttatttaagaatcctctag

SEQ ID NO: 847538 - DNA, 20 bp, mouse
ggagtttagtttggttcagt

SEQ ID NO: 847539 - DNA, 20 bp, mouse
gagtactagggacacaggga

SEQ ID NO: 847540 - DNA, 20 bp, mouse
gtttattactgagtttagtt

SEQ ID NO: 847541 - DNA, 20 bp, mouse
gttactgtacctactgctaa

SEQ ID NO: 847542 - DNA, 20 bp, mouse
gacatttgtcctttagcagt

SEQ ID NO: 847543 - DNA, 20 bp, mouse
gagtaataaatagtgtcacc

SEQ ID NO: 847544 - DNA, 20 bp, mouse
ggttagaaaatttgcaaaag

SEQ ID NO: 847545 - DNA, 20 bp, mouse
gatttgaagcaaagctcatt

SEQ ID NO: 847546 - DNA, 20 bp, mouse
ggacattaatggaatcatat

SEQ ID NO: 847547 - DNA, 20 bp, mouse
gaaaactggattgataaact

SEQ ID NO: 847548 - DNA, 20 bp, mouse
gagcttggttaacaaataag

SEQ ID NO: 847549 - DNA, 20 bp, mouse
gacatctgagttcataagct

SEQ ID NO: 847550 - DNA, 20 bp, mouse
gtaaatagtgacacttgcct

SEQ ID NO: 847551 - DNA, 20 bp, mouse
gacatcaggtattccaaatg

SEQ ID NO: 847552 - DNA, 20 bp, mouse
gtagtgctagggactcatgc

SEQ ID NO: 847553 - DNA, 20 bp, mouse
gacatgtctagtgacattaa

SEQ ID NO: 847554 - DNA, 20 bp, mouse
gaaattatggatgactcaca

SEQ ID NO: 847555 - DNA, 20 bp, mouse
gattaatattttgtgaaccc

SEQ ID NO: 847556 - DNA, 20 bp, mouse
ggcacttctcctttagtagg

SEQ ID NO: 847557 - DNA, 20 bp, mouse
gatgcatgaaaaagataatc

SEQ ID NO: 847558 - DNA, 20 bp, mouse
ggaggtatagtattaaatag

SEQ ID NO: 847559 - DNA, 20 bp, mouse
gatgttcatatctattgata

SEQ ID NO: 847560 - DNA, 20 bp, mouse
gttactagaaattatatcaa

SEQ ID NO: 847561 - DNA, 20 bp, mouse
gattgcacttctcctttagt

SEQ ID NO: 847562 - DNA, 20 bp, mouse
gatgttcaggtaaaaataag

SEQ ID NO: 847563 - DNA, 20 bp, mouse
gaattaataacagcaagtgc

SEQ ID NO: 847564 - DNA, 20 bp, mouse
gcaagtgcaggtacacatgc

SEQ ID NO: 847565 - DNA, 20 bp, mouse
gcactttatgtccttgggct

SEQ ID NO: 847566 - DNA, 20 bp, mouse
ggtaaacataagtgatatgg

SEQ ID NO: 847567 - DNA, 20 bp, mouse
gcatgtaaacataagtgata

SEQ ID NO: 847568 - DNA, 20 bp, mouse
gaagtgctggggtcacatgc

SEQ ID NO: 847569 - DNA, 20 bp, mouse
ggagttaaattgagttgagt

SEQ ID NO: 847570 - DNA, 20 bp, mouse
gttaatatccataagtgctg

SEQ ID NO: 847571 - DNA, 20 bp, mouse
gtaaatagtggtgcctggat

SEQ ID NO: 847572 - DNA, 20 bp, mouse
gcactctctggccttgggct

SEQ ID NO: 847573 - DNA, 20 bp, mouse
gttactgttcttacttctaa

SEQ ID NO: 847574 - DNA, 20 bp, mouse
gagtaataaatagtggtgcc

SEQ ID NO: 847575 - DNA, 20 bp, mouse
ggtagaaatgatcatcaggc

SEQ ID NO: 847576 - DNA, 20 bp, mouse
gtcctccagaggagaagaac

SEQ ID NO: 847577 - DNA, 20 bp, mouse
gtcaacctgttcttctcctc

SEQ ID NO: 847578 - DNA, 20 bp, mouse
gttaagcattatcttgcctg

SEQ ID NO: 847579 - DNA, 20 bp, mouse
gcgaggtcagagaactagtt

SEQ ID NO: 847580 - DNA, 20 bp, mouse
gctcatgaatccaactatgt

SEQ ID NO: 847581 - DNA, 20 bp, mouse
gcggtctgaaatagatgact

SEQ ID NO: 847582 - DNA, 20 bp, mouse
gattactgtactttcatcta

SEQ ID NO: 847583 - DNA, 20 bp, mouse
gtggcaaaactgagtcattc

SEQ ID NO: 847584 - DNA, 20 bp, mouse
gcagtttccaccaacatagt

SEQ ID NO: 847585 - DNA, 20 bp, mouse
gatgaatccaactatgttgg

SEQ ID NO: 847586 - DNA, 20 bp, mouse
gtatggccaggtgaaaaata

SEQ ID NO: 847587 - DNA, 20 bp, mouse
gctctgcatctgagatccta

SEQ ID NO: 847588 - DNA, 20 bp, mouse
gtccagacatgattattttt

SEQ ID NO: 847589 - DNA, 20 bp, mouse
ggaggtcagttgggtttagt

SEQ ID NO: 847590 - DNA, 20 bp, mouse
ggcaaatgatttcagaacac

SEQ ID NO: 847591 - DNA, 20 bp, mouse
gtatttgaatgcattttata

SEQ ID NO: 847592 - DNA, 20 bp, mouse
gaactgacctcagtaataaa

SEQ ID NO: 847593 - DNA, 20 bp, mouse
gttcatttaagtagacatga

SEQ ID NO: 847594 - DNA, 20 bp, mouse
gattaatccttttattactg

SEQ ID NO: 847595 - DNA, 20 bp, mouse
gaagttcacttttgttacat

SEQ ID NO: 847596 - DNA, 20 bp, mouse
gttcatgtaagtaaacataa

SEQ ID NO: 847597 - DNA, 20 bp, mouse
ggagttcactctgattacat

SEQ ID NO: 847598 - DNA, 20 bp, mouse
ggtagacaataactttatat

SEQ ID NO: 847599 - DNA, 20 bp, mouse
gcagtgtttaagatgcataa

SEQ ID NO: 847600 - DNA, 20 bp, mouse
gtatgtccaggtgaaaaaga

SEQ ID NO: 847601 - DNA, 20 bp, mouse
ggttccagacatgatttctt

SEQ ID NO: 847602 - DNA, 20 bp, mouse
ggttctgtaatagtaactac

SEQ ID NO: 847603 - DNA, 20 bp, mouse
gaattgcttgtaaaacttat

SEQ ID NO: 847604 - DNA, 20 bp, mouse
gagaagcactctctgccctt

SEQ ID NO: 847605 - DNA, 20 bp, mouse
gtccccaaagaaatcatgtc

SEQ ID NO: 847606 - DNA, 20 bp, mouse
gcagtgtttaagatgcataa

SEQ ID NO: 847607 - DNA, 20 bp, mouse
ggagttcactctgattatgt

SEQ ID NO: 847608 - DNA, 20 bp, mouse
ggcagcatgaagtatcaggc

SEQ ID NO: 847609 - DNA, 20 bp, mouse
gtatgtccaggtgaaaaaca

SEQ ID NO: 847610 - DNA, 20 bp, mouse
gtccagacatgatttctttt

SEQ ID NO: 847611 - DNA, 20 bp, mouse
gtgaagcactctctgccctt

SEQ ID NO: 847612 - DNA, 20 bp, mouse
gaaatgcagcatgaagtatc

SEQ ID NO: 847613 - DNA, 20 bp, mouse
gtcccaaaagaaatcatgtc

SEQ ID NO: 847614 - DNA, 20 bp, mouse
gtcaattgggttcagttggt

SEQ ID NO: 847615 - DNA, 20 bp, mouse
gtgacaactgaatgtgttca

SEQ ID NO: 847616 - DNA, 20 bp, mouse
gcccgatgacatagaatgaa

SEQ ID NO: 847617 - DNA, 20 bp, mouse
gtatgtcatcgggaaaattc

SEQ ID NO: 847618 - DNA, 20 bp, mouse
gtccattcattctatgtcat

SEQ ID NO: 847619 - DNA, 20 bp, mouse
gactgttgaatatgactaag

SEQ ID NO: 847620 - DNA, 20 bp, mouse
gtgacatacagcattgagcc

SEQ ID NO: 847621 - DNA, 20 bp, mouse
ggagaaagaatgctcactcc

SEQ ID NO: 847622 - DNA, 20 bp, mouse
ggtttggtccaagctgtcca

SEQ ID NO: 847623 - DNA, 20 bp, mouse
gcccagggataatcttcccc

SEQ ID NO: 847624 - DNA, 20 bp, mouse
gtacctgtgtgtctctttta

SEQ ID NO: 847625 - DNA, 20 bp, mouse
gatacatatggctgttgaca

SEQ ID NO: 847626 - DNA, 20 bp, mouse
gatcatctagagacgttttc

SEQ ID NO: 847627 - DNA, 20 bp, mouse
gatctgtctgtacacccctg

SEQ ID NO: 847628 - DNA, 20 bp, mouse
gttctctctttaacacatgc

SEQ ID NO: 847629 - DNA, 20 bp, mouse
ggagaagcagaaagtgacac

SEQ ID NO: 847630 - DNA, 20 bp, mouse
gtcagaatcctgagacacat

SEQ ID NO: 847631 - DNA, 20 bp, mouse
gcactggaatttttcagtct

SEQ ID NO: 847632 - DNA, 20 bp, mouse
gtcaaaagcatcaattttta

SEQ ID NO: 847633 - DNA, 20 bp, mouse
gtgactttcctatgtgtctc

SEQ ID NO: 847634 - DNA, 20 bp, mouse
gtaattaaaccatcaattca

SEQ ID NO: 847635 - DNA, 20 bp, mouse
gtatatatgttacacaccat

SEQ ID NO: 847636 - DNA, 20 bp, mouse
gaccctggggttttcagtct

SEQ ID NO: 847637 - DNA, 20 bp, mouse
ggtattaattttatggactc

SEQ ID NO: 847638 - DNA, 20 bp, mouse
ggcatgtatcaaagacagaa

SEQ ID NO: 847639 - DNA, 20 bp, mouse
ggaattgatggtttaattaa

SEQ ID NO: 847640 - DNA, 20 bp, mouse
gtccaagactgaaaacccca

SEQ ID NO: 847641 - DNA, 20 bp, mouse
gtcagaatcctgagacacat

SEQ ID NO: 847642 - DNA, 20 bp, mouse
gagacacataggaaagtaaa

SEQ ID NO: 847643 - DNA, 20 bp, mouse
gctcaaaaaaaaatctgtct

SEQ ID NO: 847644 - DNA, 20 bp, mouse
ggtaaaaggtattaatttta

SEQ ID NO: 847645 - DNA, 20 bp, mouse
gcatcaaagataatcattat

SEQ ID NO: 847646 - DNA, 20 bp, mouse
gcaagactgaaaaaacccca

SEQ ID NO: 847647 - DNA, 20 bp, mouse
gtcagaatcctgagactcgt

SEQ ID NO: 847648 - DNA, 20 bp, mouse
gtatctggacattatcttga

SEQ ID NO: 847649 - DNA, 20 bp, mouse
gtgactttcctacgagtctc

SEQ ID NO: 847650 - DNA, 20 bp, mouse
gtttcaaaaaacatctgtct

SEQ ID NO: 847651 - DNA, 20 bp, mouse
gtcaaaagcattaattttta

SEQ ID NO: 847652 - DNA, 20 bp, mouse
ggaagcagaaagcaaccctg

SEQ ID NO: 847653 - DNA, 20 bp, mouse
gctgtcttggtacacccctg

SEQ ID NO: 847654 - DNA, 20 bp, mouse
gatcatctagagacgtttca

SEQ ID NO: 847655 - DNA, 20 bp, mouse
gtatatatgttacacaccat

SEQ ID NO: 847656 - DNA, 20 bp, mouse
gctaccaaactctcaagggg

SEQ ID NO: 847657 - DNA, 20 bp, mouse
gaagtgctaccaaactctca

SEQ ID NO: 847658 - DNA, 20 bp, mouse
ggaatccatgcaaatatctc

SEQ ID NO: 847659 - DNA, 20 bp, mouse
gctagcttagtaaacccttg

SEQ ID NO: 847660 - DNA, 20 bp, mouse
gagaaggagaatctatccat

SEQ ID NO: 847661 - DNA, 20 bp, mouse
gacaaggaaagatccagacc

SEQ ID NO: 847662 - DNA, 20 bp, mouse
gttgcttcaggctctccatc

SEQ ID NO: 847663 - DNA, 20 bp, mouse
gtggtagcactttttgcttc

SEQ ID NO: 847664 - DNA, 20 bp, mouse
gtctccaccccttgagagtt

SEQ ID NO: 847665 - DNA, 20 bp, mouse
ggaacaaataattgtgatta

SEQ ID NO: 847666 - DNA, 20 bp, mouse
ggaccattacataatatgaa

SEQ ID NO: 847667 - DNA, 20 bp, mouse
gcatattatgtaatggtccc

SEQ ID NO: 847668 - DNA, 20 bp, mouse
gttacataatatgaatggaa

SEQ ID NO: 847669 - DNA, 20 bp, mouse
gtcacattaaacatggagag

SEQ ID NO: 847670 - DNA, 20 bp, mouse
gggaagtctcacattaaaca

SEQ ID NO: 847671 - DNA, 20 bp, mouse
gcaggagaagattgtccttg

SEQ ID NO: 847672 - DNA, 20 bp, mouse
ggtacattgcataaacccca

SEQ ID NO: 847673 - DNA, 20 bp, mouse
gaatgaaatcataccatctg

SEQ ID NO: 847674 - DNA, 20 bp, mouse
gaaatcataccatctgagga

SEQ ID NO: 847675 - DNA, 20 bp, mouse
gaatggtccctggatacata

SEQ ID NO: 847676 - DNA, 20 bp, mouse
gtatccagggaacatggcat

SEQ ID NO: 847677 - DNA, 20 bp, mouse
gaaatcatgccacctgagta

SEQ ID NO: 847678 - DNA, 20 bp, mouse
gtgtatgtatccagggaaca

SEQ ID NO: 847679 - DNA, 20 bp, mouse
gcatcatggtttccatactc

SEQ ID NO: 847680 - DNA, 20 bp, mouse
gttttaaggataatgttgtc

SEQ ID NO: 847681 - DNA, 20 bp, mouse
ggaacatggcataggataaa

SEQ ID NO: 847682 - DNA, 20 bp, mouse
gcatggtttccatactcagg

SEQ ID NO: 847683 - DNA, 20 bp, mouse
gtcacattaaacatggagag

SEQ ID NO: 847684 - DNA, 20 bp, mouse
gggaagtctcacattaaaca

SEQ ID NO: 847685 - DNA, 20 bp, mouse
gtttataactgtttgtttta

SEQ ID NO: 847686 - DNA, 20 bp, mouse
gttgtgaagtccatttatta

SEQ ID NO: 847687 - DNA, 20 bp, mouse
gcatcgtctagcatagggaa

SEQ ID NO: 847688 - DNA, 20 bp, mouse
gagagagaaagttcaactcc

SEQ ID NO: 847689 - DNA, 20 bp, mouse
gtcttccatcgtctagcata

SEQ ID NO: 847690 - DNA, 20 bp, mouse
gtcacattaaacatgaagcc

SEQ ID NO: 847691 - DNA, 20 bp, mouse
gtgagaaggttgtaaatgtt

SEQ ID NO: 847692 - DNA, 20 bp, mouse
ggtttatattttggacatca

SEQ ID NO: 847693 - DNA, 20 bp, mouse
gcacatttctgtttatattt

SEQ ID NO: 847694 - DNA, 20 bp, mouse
gtatttgtctccataataaa

SEQ ID NO: 847695 - DNA, 20 bp, mouse
gaatgaaatcatgccatctg

SEQ ID NO: 847696 - DNA, 20 bp, mouse
gcaaactttgagtttattca

SEQ ID NO: 847697 - DNA, 20 bp, mouse
gggcagtctcacatgaaaca

SEQ ID NO: 847698 - DNA, 20 bp, mouse
gcacatgaaacaaggagcca

SEQ ID NO: 847699 - DNA, 20 bp, mouse
gcagagagaaagttcaaccc

SEQ ID NO: 847700 - DNA, 20 bp, mouse
gcatggtttctatcctcaag

SEQ ID NO: 847701 - DNA, 20 bp, mouse
gaatgaaatcatgccacttg

SEQ ID NO: 847702 - DNA, 20 bp, mouse
gcttccctacactagacaat

SEQ ID NO: 847703 - DNA, 20 bp, mouse
ggcctcaagctctacatcta

SEQ ID NO: 847704 - DNA, 20 bp, mouse
gcatgctccctggacacata

SEQ ID NO: 847705 - DNA, 20 bp, mouse
ggaattttccctatgtgtcc

SEQ ID NO: 847706 - DNA, 20 bp, mouse
gtgcaggagaaaactgtcct

SEQ ID NO: 847707 - DNA, 20 bp, mouse
gtcacatgtaacattgaacc

SEQ ID NO: 847708 - DNA, 20 bp, mouse
gcagagagtatggtaactcc

SEQ ID NO: 847709 - DNA, 20 bp, mouse
gatcttttcaacttttgtca

SEQ ID NO: 847710 - DNA, 20 bp, mouse
gatgcatagcaaaaatccca

SEQ ID NO: 847711 - DNA, 20 bp, mouse
gatgcatatgaatgcaatca

SEQ ID NO: 847712 - DNA, 20 bp, mouse
gtcaatgttacatgtgagac

SEQ ID NO: 847713 - DNA, 20 bp, mouse
gcaaatgttgtgtttaatca

SEQ ID NO: 847714 - DNA, 20 bp, mouse
gacacaacatttgaatgata

SEQ ID NO: 847715 - DNA, 20 bp, mouse
gaatgcaatcatggcccctg

SEQ ID NO: 847716 - DNA, 20 bp, mouse
gggtctggtctgagcaatga

SEQ ID NO: 847717 - DNA, 20 bp, mouse
gaatacagtcatggccccca

SEQ ID NO: 847718 - DNA, 20 bp, mouse
ggatcatgttttgtaccctt

SEQ ID NO: 847719 - DNA, 20 bp, mouse
gctcaacttctgtcatagta

SEQ ID NO: 847720 - DNA, 20 bp, mouse
ggcaagtctcacatacaaca

SEQ ID NO: 847721 - DNA, 20 bp, mouse
ggacatgttctccagatagc

SEQ ID NO: 847722 - DNA, 20 bp, mouse
gtcctgtgattcctgctatc

SEQ ID NO: 847723 - DNA, 20 bp, mouse
gatgcatatgaatacagtca

SEQ ID NO: 847724 - DNA, 20 bp, mouse
gtccagatagcaggaatcac

SEQ ID NO: 847725 - DNA, 20 bp, mouse
gaggaatcacaggaagtttg

SEQ ID NO: 847726 - DNA, 20 bp, mouse
gaagttgatcttctgagagc

SEQ ID NO: 847727 - DNA, 20 bp, mouse
gtgacatacagcattgagcc

SEQ ID NO: 847728 - DNA, 20 bp, mouse
ggagaaagaatgctcactcc

SEQ ID NO: 847729 - DNA, 20 bp, mouse
ggccatatgtataaacacta

SEQ ID NO: 847730 - DNA, 20 bp, mouse
gtacaacatgttttcaaaaa

SEQ ID NO: 847731 - DNA, 20 bp, mouse
ggtttggtccaagctgtcca

SEQ ID NO: 847732 - DNA, 20 bp, mouse
gcccagggataatcttcccc

SEQ ID NO: 847733 - DNA, 20 bp, mouse
gatccttaaaagagacacac

SEQ ID NO: 847734 - DNA, 20 bp, mouse
gatacatatggctgttgaca

SEQ ID NO: 847735 - DNA, 20 bp, mouse
gtatggctgttgacatggtt

SEQ ID NO: 847736 - DNA, 20 bp, mouse
ggtctcaatgacagtgaagg

SEQ ID NO: 847737 - DNA, 20 bp, mouse
gttggccaaaacatcccatt

SEQ ID NO: 847738 - DNA, 20 bp, mouse
gagggatcaacatcccaaat

SEQ ID NO: 847739 - DNA, 20 bp, mouse
gaaacaggcagcaagacctc

SEQ ID NO: 847740 - DNA, 20 bp, mouse
gcagctgaagttgttttcgt

SEQ ID NO: 847741 - DNA, 20 bp, mouse
ggctgaaatcatcatgcctg

SEQ ID NO: 847742 - DNA, 20 bp, mouse
gttttcgtgggaaaagtatc

SEQ ID NO: 847743 - DNA, 20 bp, mouse
gcatcccaaatgggatgttt

SEQ ID NO: 847744 - DNA, 20 bp, mouse
gtgaaacactgaaagtcaat

SEQ ID NO: 847745 - DNA, 20 bp, mouse
gaagtatctggaatcaaact

SEQ ID NO: 847746 - DNA, 20 bp, mouse
gattaacaagtgtgagttat

SEQ ID NO: 847747 - DNA, 20 bp, mouse
gtatattgtataaacttgat

SEQ ID NO: 847748 - DNA, 20 bp, mouse
gtaggctgatgtaaccctac

SEQ ID NO: 847749 - DNA, 20 bp, mouse
gtcctctgatgtaacctgta

SEQ ID NO: 847750 - DNA, 20 bp, mouse
gagggattgagaatccaatt

SEQ ID NO: 847751 - DNA, 20 bp, mouse
gtagtctttgctgaagtcat

SEQ ID NO: 847752 - DNA, 20 bp, mouse
ggaaccaagcatacatgtac

SEQ ID NO: 847753 - DNA, 20 bp, mouse
gtatattgcagcgctttagt

SEQ ID NO: 847754 - DNA, 20 bp, mouse
gagaagcagagtccatggga

SEQ ID NO: 847755 - DNA, 20 bp, mouse
gctgaagtcatagggccttt

SEQ ID NO: 847756 - DNA, 20 bp, mouse
gagttggcaattaacaagtg

SEQ ID NO: 847757 - DNA, 20 bp, mouse
gctacaaacagcaagagttc

SEQ ID NO: 847758 - DNA, 20 bp, mouse
gtatattgtataaacttgat

SEQ ID NO: 847759 - DNA, 20 bp, mouse
gtaggctgatgtaaccccac

SEQ ID NO: 847760 - DNA, 20 bp, mouse
gagggattgagaatcccatt

SEQ ID NO: 847761 - DNA, 20 bp, mouse
gagtctttgctgacgtcata

SEQ ID NO: 847762 - DNA, 20 bp, mouse
ggccaattcatcccaagaga

SEQ ID NO: 847763 - DNA, 20 bp, mouse
gtgtattgcagctctttagt

SEQ ID NO: 847764 - DNA, 20 bp, mouse
gagcagcagagtccatggga

SEQ ID NO: 847765 - DNA, 20 bp, mouse
gctgacgtcatagggccttt

SEQ ID NO: 847766 - DNA, 20 bp, mouse
gcctcagcacaagaatctaa

SEQ ID NO: 847767 - DNA, 20 bp, mouse
gctaatcattccagcggatt

SEQ ID NO: 847768 - DNA, 20 bp, mouse
ggcacaagaatctaagggaa

SEQ ID NO: 847769 - DNA, 20 bp, mouse
ggcggattgggaatgcaatt

SEQ ID NO: 847770 - DNA, 20 bp, mouse
gctcagactaatcattccag

SEQ ID NO: 847771 - DNA, 20 bp, mouse
gtcttatgatggaacctgtg

SEQ ID NO: 847772 - DNA, 20 bp, mouse
ggaatcaagcatatatgtag

SEQ ID NO: 847773 - DNA, 20 bp, mouse
gtgtattcttcactagccat

SEQ ID NO: 847774 - DNA, 20 bp, mouse
gctcttctcttgggaaaaat

SEQ ID NO: 847775 - DNA, 20 bp, mouse
gcttagtttgcctcttatga

SEQ ID NO: 847776 - DNA, 20 bp, mouse
gttctgacttaattcctgtc

SEQ ID NO: 847777 - DNA, 20 bp, mouse
gtcagcttcaatgtaaacag

SEQ ID NO: 847778 - DNA, 20 bp, mouse
ggatgttctcctggattttt

SEQ ID NO: 847779 - DNA, 20 bp, mouse
gtgtttttcatatgaatagc

SEQ ID NO: 847780 - DNA, 20 bp, mouse
gcaactaagtgaaaaggaaa

SEQ ID NO: 847781 - DNA, 20 bp, mouse
gagcaatccccaaaaaatcc

SEQ ID NO: 847782 - DNA, 20 bp, mouse
ggctgatcaactaagtgaaa

SEQ ID NO: 847783 - DNA, 20 bp, mouse
gtaatatgaaaaaacaattt

SEQ ID NO: 847784 - DNA, 20 bp, mouse
gtactaatatttctcctgac

SEQ ID NO: 847785 - DNA, 20 bp, mouse
gtttcttgtgtcatatgctt

SEQ ID NO: 847786 - DNA, 20 bp, mouse
gaattccaaactttttttgc

SEQ ID NO: 847787 - DNA, 20 bp, mouse
ggggacactaattattccat

SEQ ID NO: 847788 - DNA, 20 bp, mouse
gtcttctcttgggatgaatt

SEQ ID NO: 847789 - DNA, 20 bp, mouse
gttgaaactgttttttcacg

SEQ ID NO: 847790 - DNA, 20 bp, mouse
gaaagtcattctaaatccaa

SEQ ID NO: 847791 - DNA, 20 bp, mouse
gatatgtactggacactatt

SEQ ID NO: 847792 - DNA, 20 bp, mouse
ggtttgttgatgactcagtc

SEQ ID NO: 847793 - DNA, 20 bp, mouse
gtttacctgcaaaaaaagtt

SEQ ID NO: 847794 - DNA, 20 bp, mouse
gcatattgtaccaaatgtct

SEQ ID NO: 847795 - DNA, 20 bp, mouse
gacaaaaaagtgtgaattat

SEQ ID NO: 847796 - DNA, 20 bp, mouse
gtgaataatatatgccttaa

SEQ ID NO: 847797 - DNA, 20 bp, mouse
gagttcatctgttcatgata

SEQ ID NO: 847798 - DNA, 20 bp, mouse
gaaatacattaggcttaagc

SEQ ID NO: 847799 - DNA, 20 bp, mouse
gcattatttattgaccctta

SEQ ID NO: 847800 - DNA, 20 bp, mouse
gtgaacagatgaactggatt

SEQ ID NO: 847801 - DNA, 20 bp, mouse
gtggattaggtaaatacatt

SEQ ID NO: 847802 - DNA, 20 bp, mouse
gtatattattcatatttcat

SEQ ID NO: 847803 - DNA, 20 bp, mouse
gtctattcacatatagaagc

SEQ ID NO: 847804 - DNA, 20 bp, mouse
gaataaataatgagtagtaa

SEQ ID NO: 847805 - DNA, 20 bp, mouse
ggtagatctgtgaatctctg

SEQ ID NO: 847806 - DNA, 20 bp, mouse
gcactcaggagaagatcaaa

SEQ ID NO: 847807 - DNA, 20 bp, mouse
gtcctgaaggaatagaagac

SEQ ID NO: 847808 - DNA, 20 bp, mouse
gggtgagtcttgaaacttag

SEQ ID NO: 847809 - DNA, 20 bp, mouse
gttacgtagtaaatgaagcc

SEQ ID NO: 847810 - DNA, 20 bp, mouse
gggctcacagctcttggtga

SEQ ID NO: 847811 - DNA, 20 bp, mouse
gtttaacagaaatttttgtt

SEQ ID NO: 847812 - DNA, 20 bp, mouse
gaactaaattttattcctga

SEQ ID NO: 847813 - DNA, 20 bp, mouse
gtcctgtcttctattccttc

SEQ ID NO: 847814 - DNA, 20 bp, mouse
gtcaattggctcacagctct

SEQ ID NO: 847815 - DNA, 20 bp, mouse
gaaactaatctgaagcaaat

SEQ ID NO: 847816 - DNA, 20 bp, mouse
gtcctatgaggtaaactata

SEQ ID NO: 847817 - DNA, 20 bp, mouse
gctacaaacagaaagagtgc

SEQ ID NO: 847818 - DNA, 20 bp, mouse
gtacattctctactagccaa

SEQ ID NO: 847819 - DNA, 20 bp, mouse
gaaacaacttccaagacgtt

SEQ ID NO: 847820 - DNA, 20 bp, mouse
gcttattgtaccaaacgtct

SEQ ID NO: 847821 - DNA, 20 bp, mouse
gtttcttgattcatatagtt

SEQ ID NO: 847822 - DNA, 20 bp, mouse
ggcaatgtactaattttgac

SEQ ID NO: 847823 - DNA, 20 bp, mouse
gcgtttggtacaataagcat

SEQ ID NO: 847824 - DNA, 20 bp, mouse
ggctgaagtcatagagcctt

SEQ ID NO: 847825 - DNA, 20 bp, mouse
gtccctatagtttacctcat

SEQ ID NO: 847826 - DNA, 20 bp, mouse
gttgcggcccccaggagtta

SEQ ID NO: 847827 - DNA, 20 bp, mouse
gtgggggccgcaaatcttca

SEQ ID NO: 847828 - DNA, 20 bp, mouse
gtcacggctgggaaggataa

SEQ ID NO: 847829 - DNA, 20 bp, mouse
gggcccccaggagttaggga

SEQ ID NO: 847830 - DNA, 20 bp, mouse
gcgcaaatcttcagggttcc

SEQ ID NO: 847831 - DNA, 20 bp, mouse
gggccctaatttaaactcag

SEQ ID NO: 847832 - DNA, 20 bp, mouse
gaatacttaacactagctcc

SEQ ID NO: 847833 - DNA, 20 bp, mouse
gagccactgagtttaaatta

SEQ ID NO: 847834 - DNA, 20 bp, mouse
gaactaatctgctccagtcc

SEQ ID NO: 847835 - DNA, 20 bp, mouse
gtccctcagtttactggggt

SEQ ID NO: 847836 - DNA, 20 bp, mouse
gtcctcgcgggatttcggtt

SEQ ID NO: 847837 - DNA, 20 bp, mouse
gcccgcgaggaacctcccgg

SEQ ID NO: 847838 - DNA, 20 bp, mouse
gtcccggtggccgaaaggag

SEQ ID NO: 847839 - DNA, 20 bp, mouse
ggaacctcccggtggccgaa

SEQ ID NO: 847840 - DNA, 20 bp, mouse
gaatcccgcgaggaacctcc

SEQ ID NO: 847841 - DNA, 20 bp, mouse
ggacgcgagcgagttccggt

SEQ ID NO: 847842 - DNA, 20 bp, mouse
gaagtgacgcgagcgagttc

SEQ ID NO: 847843 - DNA, 20 bp, mouse
gttctcggttcgggctctgt

SEQ ID NO: 847844 - DNA, 20 bp, mouse
gcgaagcgtgttccttgttc

SEQ ID NO: 847845 - DNA, 20 bp, mouse
gctcgtctcgctcacctcgc

SEQ ID NO: 847846 - DNA, 20 bp, mouse
gtgacctccaggcagtgggt

SEQ ID NO: 847847 - DNA, 20 bp, mouse
gtgagcccccacccactgcc

SEQ ID NO: 847848 - DNA, 20 bp, mouse
gagtgggtgggggctcactt

SEQ ID NO: 847849 - DNA, 20 bp, mouse
ggggtgggggctcacttagg

SEQ ID NO: 847850 - DNA, 20 bp, mouse
gtcacacgtgaggttatgac

SEQ ID NO: 847851 - DNA, 20 bp, mouse
gaacctcacgtgtgacctcc

SEQ ID NO: 847852 - DNA, 20 bp, mouse
gagaaatgtccttagttctc

SEQ ID NO: 847853 - DNA, 20 bp, mouse
gtgtccttagttctctggtc

SEQ ID NO: 847854 - DNA, 20 bp, mouse
ggctccgtggaagcccactg

SEQ ID NO: 847855 - DNA, 20 bp, mouse
gccctgtctggtaaaagctt

SEQ ID NO: 847856 - DNA, 20 bp, mouse
gtactggtcaagttcttaat

SEQ ID NO: 847857 - DNA, 20 bp, mouse
gaggccaactcatctctaaa

SEQ ID NO: 847858 - DNA, 20 bp, mouse
gtagtatggactcaactggt

SEQ ID NO: 847859 - DNA, 20 bp, mouse
gttgaccagtacgtttagta

SEQ ID NO: 847860 - DNA, 20 bp, mouse
ggagtccatactaaacgtac

SEQ ID NO: 847861 - DNA, 20 bp, mouse
gtatacttatggctgcaata

SEQ ID NO: 847862 - DNA, 20 bp, mouse
ggaacagggttatgcaagat

SEQ ID NO: 847863 - DNA, 20 bp, mouse
gtctgtaccaagtccatgac

SEQ ID NO: 847864 - DNA, 20 bp, mouse
gaattgttgacattgctcag

SEQ ID NO: 847865 - DNA, 20 bp, mouse
gtggtcaggtcaatccagga

SEQ ID NO: 847866 - DNA, 20 bp, mouse
ggcgggacgcggagacagcg

SEQ ID NO: 847867 - DNA, 20 bp, mouse
gcgcccgtgaggtggatcgg

SEQ ID NO: 847868 - DNA, 20 bp, mouse
gctcacgggcgcgcgctcgt

SEQ ID NO: 847869 - DNA, 20 bp, mouse
gcgcccccgatccacctcac

SEQ ID NO: 847870 - DNA, 20 bp, mouse
gggcctgatgtctcctctct

SEQ ID NO: 847871 - DNA, 20 bp, mouse
gcgcgctccacagactttgc

SEQ ID NO: 847872 - DNA, 20 bp, mouse
gtggagcgcgctgcgggacg

SEQ ID NO: 847873 - DNA, 20 bp, mouse
gaagtctgtggagcgcgctg

SEQ ID NO: 847874 - DNA, 20 bp, mouse
gctatcaaggtgagacaaga

SEQ ID NO: 847875 - DNA, 20 bp, mouse
gaggacgcgcggcaagccgg

SEQ ID NO: 847876 - DNA, 20 bp, mouse
gaggctccggagcggggaag

SEQ ID NO: 847877 - DNA, 20 bp, mouse
gtgagcccttagatgacaca

SEQ ID NO: 847878 - DNA, 20 bp, mouse
ggcgctgaggtggtgcttaa

SEQ ID NO: 847879 - DNA, 20 bp, mouse
gcctcccccgcccttaaacg

SEQ ID NO: 847880 - DNA, 20 bp, mouse
gttggcgcgaggctccggag

SEQ ID NO: 847881 - DNA, 20 bp, mouse
gggtgtgtaacgttggcgcg

SEQ ID NO: 847882 - DNA, 20 bp, mouse
ggggacatcaaagcgctcct

SEQ ID NO: 847883 - DNA, 20 bp, mouse
gtaacgttggcgcgaggctc

SEQ ID NO: 847884 - DNA, 20 bp, mouse
ggcgcgcgggtgtgtaacgt

SEQ ID NO: 847885 - DNA, 20 bp, mouse
gcccagaagtcaatgcgctg

SEQ ID NO: 847886 - DNA, 20 bp, mouse
gcccagaggccccacggcga

SEQ ID NO: 847887 - DNA, 20 bp, mouse
gccgtggggcctctgggcgg

SEQ ID NO: 847888 - DNA, 20 bp, mouse
ggaccactgcccactaaacg

SEQ ID NO: 847889 - DNA, 20 bp, mouse
gggggccgcggggagctcgt

SEQ ID NO: 847890 - DNA, 20 bp, mouse
gcggtggagccgcgtttagt

SEQ ID NO: 847891 - DNA, 20 bp, mouse
gagcagcgctccgacccggg

SEQ ID NO: 847892 - DNA, 20 bp, mouse
gagggtagggaaaccggctc

SEQ ID NO: 847893 - DNA, 20 bp, mouse
gttccctaccctcaactagg

SEQ ID NO: 847894 - DNA, 20 bp, mouse
gagacagagcaggctccggg

SEQ ID NO: 847895 - DNA, 20 bp, mouse
gagggggaaacgtctcacct

SEQ ID NO: 847896 - DNA, 20 bp, mouse
gtgtgggctcatctccctga

SEQ ID NO: 847897 - DNA, 20 bp, mouse
ggcctggtgaatggaatgag

SEQ ID NO: 847898 - DNA, 20 bp, mouse
gttcttggtggggaagattc

SEQ ID NO: 847899 - DNA, 20 bp, mouse
gtgtgcagtgagctgagtgt

SEQ ID NO: 847900 - DNA, 20 bp, mouse
gaatttggggtctcagaaag

SEQ ID NO: 847901 - DNA, 20 bp, mouse
gttccccaccaagaacaaag

SEQ ID NO: 847902 - DNA, 20 bp, mouse
gagctcctaaatgcacatat

SEQ ID NO: 847903 - DNA, 20 bp, mouse
gcatttaaatgcctggtgaa

SEQ ID NO: 847904 - DNA, 20 bp, mouse
gtggacctatatgtgcattt

SEQ ID NO: 847905 - DNA, 20 bp, mouse
gtcatacagcaggaaatttg

SEQ ID NO: 847906 - DNA, 20 bp, mouse
gaagggctctgatctcctgc

SEQ ID NO: 847907 - DNA, 20 bp, mouse
gcactaggaaagggtatgag

SEQ ID NO: 847908 - DNA, 20 bp, mouse
gttcctgcaaatggatgtga

SEQ ID NO: 847909 - DNA, 20 bp, mouse
gggtagatatacactaggaa

SEQ ID NO: 847910 - DNA, 20 bp, mouse
gaagggtatgagaggctgtc

SEQ ID NO: 847911 - DNA, 20 bp, mouse
gccaggacatttggaagata

SEQ ID NO: 847912 - DNA, 20 bp, mouse
ggatgcttgtagtacaggga

SEQ ID NO: 847913 - DNA, 20 bp, mouse
gaatgccaacttcctgcaaa

SEQ ID NO: 847914 - DNA, 20 bp, mouse
ggacacatgtgtctggggcc

SEQ ID NO: 847915 - DNA, 20 bp, mouse
ggaaggacgacacatgtgtc

SEQ ID NO: 847916 - DNA, 20 bp, mouse
gtggggagcatgcgcacaaa

SEQ ID NO: 847917 - DNA, 20 bp, mouse
gcacaaaaggcttgctgctc

SEQ ID NO: 847918 - DNA, 20 bp, mouse
gctgctcgggactgagaggt

SEQ ID NO: 847919 - DNA, 20 bp, mouse
gcctctctgtggagggcatg

SEQ ID NO: 847920 - DNA, 20 bp, mouse
gttgagacaccgcctctctg

SEQ ID NO: 847921 - DNA, 20 bp, mouse
gagagtggtggcgcgattcg

SEQ ID NO: 847922 - DNA, 20 bp, mouse
gggcgagtcatgtgacagtg

SEQ ID NO: 847923 - DNA, 20 bp, mouse
gcttgctgctcgggactgag

SEQ ID NO: 847924 - DNA, 20 bp, mouse
gacgtccttcaagagagtgg

SEQ ID NO: 847925 - DNA, 20 bp, mouse
gatgcagagaataatgtttt

SEQ ID NO: 847926 - DNA, 20 bp, mouse
gaggcccggcggtccgctcg

SEQ ID NO: 847927 - DNA, 20 bp, mouse
gaccgccgggcctctcccgc

SEQ ID NO: 847928 - DNA, 20 bp, mouse
gaaaaaggagaatcattccg

SEQ ID NO: 847929 - DNA, 20 bp, mouse
gcgcgcctccagttccgcgt

SEQ ID NO: 847930 - DNA, 20 bp, mouse
ggggcgtgatgataaccgac

SEQ ID NO: 847931 - DNA, 20 bp, mouse
gtgcccgcgagcggaccgcc

SEQ ID NO: 847932 - DNA, 20 bp, mouse
ggagcgagagtgaaggacgg

SEQ ID NO: 847933 - DNA, 20 bp, mouse
gaagcgacggataggaggcg

SEQ ID NO: 847934 - DNA, 20 bp, mouse
gagcgctggagaccccgccc

SEQ ID NO: 847935 - DNA, 20 bp, mouse
gaaggagaatcattccgggg

SEQ ID NO: 847936 - DNA, 20 bp, mouse
gtgcctgcctgggacgactc

SEQ ID NO: 847937 - DNA, 20 bp, mouse
ggccaagccggagtcgtccc

SEQ ID NO: 847938 - DNA, 20 bp, mouse
gcccaggcaggcagacgcgc

SEQ ID NO: 847939 - DNA, 20 bp, mouse
gaagagctcggtgcgggatg

SEQ ID NO: 847940 - DNA, 20 bp, mouse
gaagcccgcacacccggaag

SEQ ID NO: 847941 - DNA, 20 bp, mouse
ggcggacgccaggtacccgg

SEQ ID NO: 847942 - DNA, 20 bp, mouse
gatccccgctgccaccgctc

SEQ ID NO: 847943 - DNA, 20 bp, mouse
gggaacgcagggtgccgtgg

SEQ ID NO: 847944 - DNA, 20 bp, mouse
gcaagaggcttagtagtcgg

SEQ ID NO: 847945 - DNA, 20 bp, mouse
gcggaggcggcaggaacgca

SEQ ID NO: 847946 - DNA, 20 bp, mouse
gcccccccccgcaatcgcgg

SEQ ID NO: 847947 - DNA, 20 bp, mouse
gcccacctccgcgattgcgg

SEQ ID NO: 847948 - DNA, 20 bp, mouse
gtggggtcacgcctgcgcac

SEQ ID NO: 847949 - DNA, 20 bp, mouse
gagcgacagcaccttacccc

SEQ ID NO: 847950 - DNA, 20 bp, mouse
gcgcgacgccgccagtgcgc

SEQ ID NO: 847951 - DNA, 20 bp, mouse
gggaacgcagcgcgcagggg

SEQ ID NO: 847952 - DNA, 20 bp, mouse
gccgcgattatgagatgctc

SEQ ID NO: 847953 - DNA, 20 bp, mouse
gccccccccccccgcaatcg

SEQ ID NO: 847954 - DNA, 20 bp, mouse
ggcgcagagactgacagctg

SEQ ID NO: 847955 - DNA, 20 bp, mouse
gccccccgcaatcgcggagg

SEQ ID NO: 847956 - DNA, 20 bp, mouse
gcagggctgtgctgttgtga

SEQ ID NO: 847957 - DNA, 20 bp, mouse
gggcagaagcccaactcaga

SEQ ID NO: 847958 - DNA, 20 bp, mouse
gtacatgttaacaaaataca

SEQ ID NO: 847959 - DNA, 20 bp, mouse
gagccagaagaggttttggg

SEQ ID NO: 847960 - DNA, 20 bp, mouse
gcctgccccacaaactaata

SEQ ID NO: 847961 - DNA, 20 bp, mouse
gggaaaatatcaaggaacaa

SEQ ID NO: 847962 - DNA, 20 bp, mouse
gttctggcttcccttctaac

SEQ ID NO: 847963 - DNA, 20 bp, mouse
gaatcaagagcagttggagc

SEQ ID NO: 847964 - DNA, 20 bp, mouse
gggcttcagccctctgagtt

SEQ ID NO: 847965 - DNA, 20 bp, mouse
gagggagtttctttagattg

SEQ ID NO: 847966 - DNA, 20 bp, mouse
gtgggagccatgagcatctg

SEQ ID NO: 847967 - DNA, 20 bp, mouse
gaacgccggaggagtcagaa

SEQ ID NO: 847968 - DNA, 20 bp, mouse
ggacacgggtgaccgaaagt

SEQ ID NO: 847969 - DNA, 20 bp, mouse
gttagcggccatcagaactg

SEQ ID NO: 847970 - DNA, 20 bp, mouse
gcctatgcgatccccaacgc

SEQ ID NO: 847971 - DNA, 20 bp, mouse
ggcccgagtggacctagccc

SEQ ID NO: 847972 - DNA, 20 bp, mouse
gaccagggctaggtccactc

SEQ ID NO: 847973 - DNA, 20 bp, mouse
ggatcgcatagggcgggaca

SEQ ID NO: 847974 - DNA, 20 bp, mouse
gcaccgctctccaggggcat

SEQ ID NO: 847975 - DNA, 20 bp, mouse
ggcacagatgctggaggcgt

SEQ ID NO: 847976 - DNA, 20 bp, mouse
gcccagcggcgtccagtaac

SEQ ID NO: 847977 - DNA, 20 bp, mouse
ggggccctggggtgaaagaa

SEQ ID NO: 847978 - DNA, 20 bp, mouse
ggcagcccgggatttcccag

SEQ ID NO: 847979 - DNA, 20 bp, mouse
ggcctcctagcgccaacatg

SEQ ID NO: 847980 - DNA, 20 bp, mouse
gcgacaacgcctccttgtgg

SEQ ID NO: 847981 - DNA, 20 bp, mouse
gggacgccgctgggaaatcc

SEQ ID NO: 847982 - DNA, 20 bp, mouse
gtgaggcagcaattcgattg

SEQ ID NO: 847983 - DNA, 20 bp, mouse
gtgtggaggctcaggtgccc

SEQ ID NO: 847984 - DNA, 20 bp, mouse
gatccgcgcaagcctgttac

SEQ ID NO: 847985 - DNA, 20 bp, mouse
gggactccagttaacactcg

SEQ ID NO: 847986 - DNA, 20 bp, mouse
gcactgcggcgcctcccgag

SEQ ID NO: 847987 - DNA, 20 bp, mouse
gtctccgcctcagcatgtcc

SEQ ID NO: 847988 - DNA, 20 bp, mouse
gctggggtctagaaaggaag

SEQ ID NO: 847989 - DNA, 20 bp, mouse
gtgacctcgcaatttgcaga

SEQ ID NO: 847990 - DNA, 20 bp, mouse
gtgtcagcccggacatgctg

SEQ ID NO: 847991 - DNA, 20 bp, mouse
gcagcccggacatgctgagg

SEQ ID NO: 847992 - DNA, 20 bp, mouse
ggagaccggaagccccttgt

SEQ ID NO: 847993 - DNA, 20 bp, mouse
gaaggtgaagcctccagatg

SEQ ID NO: 847994 - DNA, 20 bp, mouse
ggcgcctcccgagaggagtc

SEQ ID NO: 847995 - DNA, 20 bp, mouse
gggaggcttcaccttcgtgt

SEQ ID NO: 847996 - DNA, 20 bp, mouse
ggcgagaaggagtgaacgac

SEQ ID NO: 847997 - DNA, 20 bp, mouse
ggcagttcacggggtacagg

SEQ ID NO: 847998 - DNA, 20 bp, mouse
gactccttctcgcaccggag

SEQ ID NO: 847999 - DNA, 20 bp, mouse
gggagacttgagctagtcca

SEQ ID NO: 848000 - DNA, 20 bp, mouse
gccacccctccggtgcgaga

SEQ ID NO: 848001 - DNA, 20 bp, mouse
ggtgaacgactggaatcctt

SEQ ID NO: 848002 - DNA, 20 bp, mouse
gacttgagctagtccaggga

SEQ ID NO: 848003 - DNA, 20 bp, mouse
ggaagtggatcgcagttcac

SEQ ID NO: 848004 - DNA, 20 bp, mouse
ggaatccttcggctgatgct

SEQ ID NO: 848005 - DNA, 20 bp, mouse
gtggaagcgagagtgggcca

SEQ ID NO: 848006 - DNA, 20 bp, mouse
gtcgaaacggccttcctgaa

SEQ ID NO: 848007 - DNA, 20 bp, mouse
ggaggagccccgcctcgaaa

SEQ ID NO: 848008 - DNA, 20 bp, mouse
gtgggtgggtgacgtctggt

SEQ ID NO: 848009 - DNA, 20 bp, mouse
gggaaacttgggggactcga

SEQ ID NO: 848010 - DNA, 20 bp, mouse
gcacgccctcaaccgaaagg

SEQ ID NO: 848011 - DNA, 20 bp, mouse
gcaggaaggccgtttcgagg

SEQ ID NO: 848012 - DNA, 20 bp, mouse
gcaaccgaaaggcggggcgg

SEQ ID NO: 848013 - DNA, 20 bp, mouse
gaagggcggggcctctagca

SEQ ID NO: 848014 - DNA, 20 bp, mouse
gcacgtgacaactagctcta

SEQ ID NO: 848015 - DNA, 20 bp, mouse
gcggaggccaacaattctcg

SEQ ID NO: 848016 - DNA, 20 bp, mouse
gaccccctccaggccgtcaa

SEQ ID NO: 848017 - DNA, 20 bp, mouse
gtgcgcatgtgcagtgccaa

SEQ ID NO: 848018 - DNA, 20 bp, mouse
gcaccccttgacggcctgga

SEQ ID NO: 848019 - DNA, 20 bp, mouse
ggggcaggagaactccggcc

SEQ ID NO: 848020 - DNA, 20 bp, mouse
gttgcagtgctaggacttga

SEQ ID NO: 848021 - DNA, 20 bp, mouse
gagcgcaccccttgacggcc

SEQ ID NO: 848022 - DNA, 20 bp, mouse
gcccgagttctactggagag

SEQ ID NO: 848023 - DNA, 20 bp, mouse
ggagggggtagggaaagcga

SEQ ID NO: 848024 - DNA, 20 bp, mouse
gcggcgccgccgtagcactt

SEQ ID NO: 848025 - DNA, 20 bp, mouse
gaggacttgacggaacatct

SEQ ID NO: 848026 - DNA, 20 bp, mouse
gtgcgtaggctcaaggttag

SEQ ID NO: 848027 - DNA, 20 bp, mouse
gagctctctgcgaaaagggt

SEQ ID NO: 848028 - DNA, 20 bp, mouse
gtgtcagctctctgcgaaaa

SEQ ID NO: 848029 - DNA, 20 bp, mouse
ggagctgtaaaagccttgac

SEQ ID NO: 848030 - DNA, 20 bp, mouse
gtactccagagcgcaagctc

SEQ ID NO: 848031 - DNA, 20 bp, mouse
gccagagggtgcgtgcacaa

SEQ ID NO: 848032 - DNA, 20 bp, mouse
gaaagaagagcttggaactt

SEQ ID NO: 848033 - DNA, 20 bp, mouse
gtggaggaaacggcaggact

SEQ ID NO: 848034 - DNA, 20 bp, mouse
ggcaagccaaatccattgat

SEQ ID NO: 848035 - DNA, 20 bp, mouse
gaaagccgagtgccgatcaa

SEQ ID NO: 848036 - DNA, 20 bp, mouse
gcgtgggcggggcaaaggaa

SEQ ID NO: 848037 - DNA, 20 bp, mouse
ggctgcaagaaatcgctcgt

SEQ ID NO: 848038 - DNA, 20 bp, mouse
ggcaagaaatcgctcgtggg

SEQ ID NO: 848039 - DNA, 20 bp, mouse
gggcaacatccgggcacccg

SEQ ID NO: 848040 - DNA, 20 bp, mouse
gtgagctcgcggaaagtgcg

SEQ ID NO: 848041 - DNA, 20 bp, mouse
gtgaagtgcgggatgacggg

SEQ ID NO: 848042 - DNA, 20 bp, mouse
gcgcacttcagcatggctac

SEQ ID NO: 848043 - DNA, 20 bp, mouse
gtcgtggcgaagaatggcgg

SEQ ID NO: 848044 - DNA, 20 bp, mouse
gcagtcgtggcgaagaatgg

SEQ ID NO: 848045 - DNA, 20 bp, mouse
gtgctgaagtgcgggatgac

SEQ ID NO: 848046 - DNA, 20 bp, mouse
gttcactgctcaccattctt

SEQ ID NO: 848047 - DNA, 20 bp, mouse
gtccctaccatgcctaagaa

SEQ ID NO: 848048 - DNA, 20 bp, mouse
gtcctagtgcgcatgcgagg

SEQ ID NO: 848049 - DNA, 20 bp, mouse
gcacgtgatccgagtcgctg

SEQ ID NO: 848050 - DNA, 20 bp, mouse
gtgacagtgatgctccttca

SEQ ID NO: 848051 - DNA, 20 bp, mouse
gaaggagcatcactgtcagc

SEQ ID NO: 848052 - DNA, 20 bp, mouse
ggcacattgaacgcgaaagg

SEQ ID NO: 848053 - DNA, 20 bp, mouse
ggaggcacattgaacgcgaa

SEQ ID NO: 848054 - DNA, 20 bp, mouse
ggtagggaaatactttagaa

SEQ ID NO: 848055 - DNA, 20 bp, mouse
gaggtcctagtgcgcatgcg

SEQ ID NO: 848056 - DNA, 20 bp, mouse
ggagcactagaaggggacgg

SEQ ID NO: 848057 - DNA, 20 bp, mouse
gagcgattagagcactagaa

SEQ ID NO: 848058 - DNA, 20 bp, mouse
gaagctaaggactgaatagt

SEQ ID NO: 848059 - DNA, 20 bp, mouse
gctagaaggggacggcggcc

SEQ ID NO: 848060 - DNA, 20 bp, mouse
gttagagcactagaagggga

SEQ ID NO: 848061 - DNA, 20 bp, mouse
gcctagacatcccggaagtc

SEQ ID NO: 848062 - DNA, 20 bp, mouse
gttccgggatgtctaggaag

SEQ ID NO: 848063 - DNA, 20 bp, mouse
gtctacagagcgctgattgc

SEQ ID NO: 848064 - DNA, 20 bp, mouse
gcgagtgtgcggatgtcgtt

SEQ ID NO: 848065 - DNA, 20 bp, mouse
ggtaagcgagcagtgtaaag

SEQ ID NO: 848066 - DNA, 20 bp, mouse
gacaacgctgcggcgaacta

SEQ ID NO: 848067 - DNA, 20 bp, mouse
ggagatccgcggccgaggaa

SEQ ID NO: 848068 - DNA, 20 bp, mouse
gcggcggtgtatagtggacg

SEQ ID NO: 848069 - DNA, 20 bp, mouse
gggtcctcccaaggcagcgt

SEQ ID NO: 848070 - DNA, 20 bp, mouse
gggcagccggcggtgtatag

SEQ ID NO: 848071 - DNA, 20 bp, mouse
gacccccggcgcgtccagat

SEQ ID NO: 848072 - DNA, 20 bp, mouse
ggcggcgaactagggacagc

SEQ ID NO: 848073 - DNA, 20 bp, mouse
ggcgcgcgcagattgtcaga

SEQ ID NO: 848074 - DNA, 20 bp, mouse
gccgcggatctccttaacta

SEQ ID NO: 848075 - DNA, 20 bp, mouse
gcatgcgtagaaggatgacc

SEQ ID NO: 848076 - DNA, 20 bp, mouse
ggggcgccgcctgtccgtgt

SEQ ID NO: 848077 - DNA, 20 bp, mouse
ggcgccccgacacggacagg

SEQ ID NO: 848078 - DNA, 20 bp, mouse
ggctccctggtggccggcgg

SEQ ID NO: 848079 - DNA, 20 bp, mouse
gtgcgagcggcgctccctgg

SEQ ID NO: 848080 - DNA, 20 bp, mouse
gctgctgtcaacacttattt

SEQ ID NO: 848081 - DNA, 20 bp, mouse
gggggcgccccgacacggac

SEQ ID NO: 848082 - DNA, 20 bp, mouse
ggtgcgtcgggaacatgcaa

SEQ ID NO: 848083 - DNA, 20 bp, mouse
gccacccccgccggccacca

SEQ ID NO: 848084 - DNA, 20 bp, mouse
gaacaagtttggcagtgaca

SEQ ID NO: 848085 - DNA, 20 bp, mouse
ggagcaaatgtgcacgcgag

SEQ ID NO: 848086 - DNA, 20 bp, mouse
gagggcgagaggcgtctatg

SEQ ID NO: 848087 - DNA, 20 bp, mouse
ggcccccgccggatctactt

SEQ ID NO: 848088 - DNA, 20 bp, mouse
gccgccgggtgctagctcta

SEQ ID NO: 848089 - DNA, 20 bp, mouse
ggcctctcgccctgcgaaag

SEQ ID NO: 848090 - DNA, 20 bp, mouse
gcgccctgcgaaagggggaa

SEQ ID NO: 848091 - DNA, 20 bp, mouse
ggcggtggcggtggcggtac

SEQ ID NO: 848092 - DNA, 20 bp, mouse
gggagtggggagcccgagat

SEQ ID NO: 848093 - DNA, 20 bp, mouse
gtcccctttccccctttcgc

SEQ ID NO: 848094 - DNA, 20 bp, mouse
gtggctgtgtgggacggaac

SEQ ID NO: 848095 - DNA, 20 bp, mouse
ggggtgctagctctatggcg

SEQ ID NO: 848096 - DNA, 20 bp, mouse
ggcgctgggtgtgacgtcat

SEQ ID NO: 848097 - DNA, 20 bp, mouse
gaccgcgtgatggcgtcaca

SEQ ID NO: 848098 - DNA, 20 bp, mouse
gccagagtccgaggcttcag

SEQ ID NO: 848099 - DNA, 20 bp, mouse
gggtcatgatgtcactatgg

SEQ ID NO: 848100 - DNA, 20 bp, mouse
ggagtccgaggcttcagagg

SEQ ID NO: 848101 - DNA, 20 bp, mouse
gcgcggtcatgatgtcacta

SEQ ID NO: 848102 - DNA, 20 bp, mouse
ggggcacgtgacgccagcgc

SEQ ID NO: 848103 - DNA, 20 bp, mouse
gaagccccacccctcgcggg

SEQ ID NO: 848104 - DNA, 20 bp, mouse
gctcaagccccacccctcgc

SEQ ID NO: 848105 - DNA, 20 bp, mouse
ggtcacgtgcccccccgcga

SEQ ID NO: 848106 - DNA, 20 bp, mouse
gccaaagggaggctccagat

SEQ ID NO: 848107 - DNA, 20 bp, mouse
gcaggcgtactcgcaatggg

SEQ ID NO: 848108 - DNA, 20 bp, mouse
ggggcggagtcctacggcgg

SEQ ID NO: 848109 - DNA, 20 bp, mouse
gcagcaggccggggataccg

SEQ ID NO: 848110 - DNA, 20 bp, mouse
gtacgcctgcgcagacttgc

SEQ ID NO: 848111 - DNA, 20 bp, mouse
ggggccgagtggccttccgc

SEQ ID NO: 848112 - DNA, 20 bp, mouse
ggacgcctgcaagtctgcgc

SEQ ID NO: 848113 - DNA, 20 bp, mouse
gaatgggcggagtcctacgg

SEQ ID NO: 848114 - DNA, 20 bp, mouse
ggatattcagagcaaacgaa

SEQ ID NO: 848115 - DNA, 20 bp, mouse
gtgcgcaggcgtactcgcaa

SEQ ID NO: 848116 - DNA, 20 bp, mouse
gtgaagcgtggcaggatgaa

SEQ ID NO: 848117 - DNA, 20 bp, mouse
ggccgcggctggccagactg

SEQ ID NO: 848118 - DNA, 20 bp, mouse
ggcacccggagatctcccgc

SEQ ID NO: 848119 - DNA, 20 bp, mouse
gtgggggtggggcagatagg

SEQ ID NO: 848120 - DNA, 20 bp, mouse
gaccccggcgggagatctcc

SEQ ID NO: 848121 - DNA, 20 bp, mouse
gttgagcgacaggtttgcta

SEQ ID NO: 848122 - DNA, 20 bp, mouse
gtggctcgggaacaccccgg

SEQ ID NO: 848123 - DNA, 20 bp, mouse
gtggccgcgttctgccacca

SEQ ID NO: 848124 - DNA, 20 bp, mouse
gcaaacctgtcgctcaaagc

SEQ ID NO: 848125 - DNA, 20 bp, mouse
ggggtggggcagataggggg

SEQ ID NO: 848126 - DNA, 20 bp, mouse
gggactctgagcagctggta

SEQ ID NO: 848127 - DNA, 20 bp, mouse
gaaggcaacaggaagtccgg

SEQ ID NO: 848128 - DNA, 20 bp, mouse
gggagcttctgctgcggaag

SEQ ID NO: 848129 - DNA, 20 bp, mouse
gaggatggagttgttgctga

SEQ ID NO: 848130 - DNA, 20 bp, mouse
gctgtagcaggggtccctgg

SEQ ID NO: 848131 - DNA, 20 bp, mouse
ggccctgtagcaggggtccc

SEQ ID NO: 848132 - DNA, 20 bp, mouse
gctgccttggcgtcagtctt

SEQ ID NO: 848133 - DNA, 20 bp, mouse
gatggatgtgaactcgggtt

SEQ ID NO: 848134 - DNA, 20 bp, mouse
gagcccgagaaactgatttt

SEQ ID NO: 848135 - DNA, 20 bp, mouse
gagcctgccgtccgaaaaca

SEQ ID NO: 848136 - DNA, 20 bp, mouse
ggttaatggcggtaacagga

SEQ ID NO: 848137 - DNA, 20 bp, mouse
gaacaggagggatcacaggg

SEQ ID NO: 848138 - DNA, 20 bp, mouse
gccctgggccacagcctact

SEQ ID NO: 848139 - DNA, 20 bp, mouse
gaaggaaccagattagtgtg

SEQ ID NO: 848140 - DNA, 20 bp, mouse
gtagtcttagacttcggaga

SEQ ID NO: 848141 - DNA, 20 bp, mouse
gaccgccattaacaggggaa

SEQ ID NO: 848142 - DNA, 20 bp, mouse
gttagacttcggagagggat

SEQ ID NO: 848143 - DNA, 20 bp, mouse
gcaaaaatgagagctggcta

SEQ ID NO: 848144 - DNA, 20 bp, mouse
gctgttaccgccattaacag

SEQ ID NO: 848145 - DNA, 20 bp, mouse
gaggggaaaggatagtaact

SEQ ID NO: 848146 - DNA, 20 bp, mouse
gagcgcgggttcggggaaac

SEQ ID NO: 848147 - DNA, 20 bp, mouse
gcttctcggtagggagtgga

SEQ ID NO: 848148 - DNA, 20 bp, mouse
gtaccgagaagcgtcgggaa

SEQ ID NO: 848149 - DNA, 20 bp, mouse
ggacgcttctcggtagggag

SEQ ID NO: 848150 - DNA, 20 bp, mouse
ggccaagcgcttccctactc

SEQ ID NO: 848151 - DNA, 20 bp, mouse
gccagaagccagcacagcgc

SEQ ID NO: 848152 - DNA, 20 bp, mouse
gtgccattcccgacgcttct

SEQ ID NO: 848153 - DNA, 20 bp, mouse
gccagcacagcgcgggttcg

SEQ ID NO: 848154 - DNA, 20 bp, mouse
gcgtcatcgtagcactgggc

SEQ ID NO: 848155 - DNA, 20 bp, mouse
gcctcggcttccgggagtcc

SEQ ID NO: 848156 - DNA, 20 bp, mouse
gggccccacccctcactcgg

SEQ ID NO: 848157 - DNA, 20 bp, mouse
ggcggggtctggtgggatac

SEQ ID NO: 848158 - DNA, 20 bp, mouse
gcaggccccgcccctcttag

SEQ ID NO: 848159 - DNA, 20 bp, mouse
gtctggtgggataccggtaa

SEQ ID NO: 848160 - DNA, 20 bp, mouse
gccggtaaaaccggagtgag

SEQ ID NO: 848161 - DNA, 20 bp, mouse
gcggcccagcccgagtcacg

SEQ ID NO: 848162 - DNA, 20 bp, mouse
ggacaccgctcctctaagag

SEQ ID NO: 848163 - DNA, 20 bp, mouse
gtgaggggtggggccgacgg

SEQ ID NO: 848164 - DNA, 20 bp, mouse
gggcggggcctggtagatcc

SEQ ID NO: 848165 - DNA, 20 bp, mouse
gcggtaaagggccagcccga

SEQ ID NO: 848166 - DNA, 20 bp, mouse
gagaacaggaagccgagatg

SEQ ID NO: 848167 - DNA, 20 bp, mouse
ggaatcccccacatgccttt

SEQ ID NO: 848168 - DNA, 20 bp, mouse
ggatgcggaagtcagcctaa

SEQ ID NO: 848169 - DNA, 20 bp, mouse
ggaaacgcatcctgggtgac

SEQ ID NO: 848170 - DNA, 20 bp, mouse
gtgactggttagcgcgtgtg

SEQ ID NO: 848171 - DNA, 20 bp, mouse
gacgcgctaaccagtcaccc

SEQ ID NO: 848172 - DNA, 20 bp, mouse
gtgacgaagcggaagtgccc

SEQ ID NO: 848173 - DNA, 20 bp, mouse
gactctcgcgaaatgagaac

SEQ ID NO: 848174 - DNA, 20 bp, mouse
ggtcagcctaaaggcatgtg

SEQ ID NO: 848175 - DNA, 20 bp, mouse
ggcgtgtgcggatgacgaag

SEQ ID NO: 848176 - DNA, 20 bp, mouse
gcgaatatgcgtcacagggg

SEQ ID NO: 848177 - DNA, 20 bp, mouse
ggggaacagatgcacttccg

SEQ ID NO: 848178 - DNA, 20 bp, mouse
gcccaatcctgcatccgcac

SEQ ID NO: 848179 - DNA, 20 bp, mouse
gtccttggagacagaacctt

SEQ ID NO: 848180 - DNA, 20 bp, mouse
gtgattttgctgtgctactt

SEQ ID NO: 848181 - DNA, 20 bp, mouse
gcgtcttgcgcttgtccttc

SEQ ID NO: 848182 - DNA, 20 bp, mouse
gagaggtttcactgaacttc

SEQ ID NO: 848183 - DNA, 20 bp, mouse
gtacaaccaggcggtccttc

SEQ ID NO: 848184 - DNA, 20 bp, mouse
gaagatcgaatatgcgtcac

SEQ ID NO: 848185 - DNA, 20 bp, mouse
ggtgctacttgggtgaatcg

SEQ ID NO: 848186 - DNA, 20 bp, mouse
gggctccagcctctccggtt

SEQ ID NO: 848187 - DNA, 20 bp, mouse
ggaagaggcggggctatccc

SEQ ID NO: 848188 - DNA, 20 bp, mouse
ggtaagagcggaatccgcgc

SEQ ID NO: 848189 - DNA, 20 bp, mouse
gtctccccgtctccccctaa

SEQ ID NO: 848190 - DNA, 20 bp, mouse
ggaaccggaagttatagctc

SEQ ID NO: 848191 - DNA, 20 bp, mouse
gcggggagagaagcaatttc

SEQ ID NO: 848192 - DNA, 20 bp, mouse
gtccgctcttaccatggcgg

SEQ ID NO: 848193 - DNA, 20 bp, mouse
gcgatcggctccagcctctc

SEQ ID NO: 848194 - DNA, 20 bp, mouse
ggatcaaagcctaaccggag

SEQ ID NO: 848195 - DNA, 20 bp, mouse
gcgccgggatcctgcgacat

SEQ ID NO: 848196 - DNA, 20 bp, mouse
ggccctgggcgaagaagaga

SEQ ID NO: 848197 - DNA, 20 bp, mouse
ggggcgcccgggcgacacta

SEQ ID NO: 848198 - DNA, 20 bp, mouse
gaacccgccgcgtgcgaaca

SEQ ID NO: 848199 - DNA, 20 bp, mouse
gcgacactacggcgctggtg

SEQ ID NO: 848200 - DNA, 20 bp, mouse
gccgtggctaccgctctctg

SEQ ID NO: 848201 - DNA, 20 bp, mouse
gcgtgcgaacagggaacttg

SEQ ID NO: 848202 - DNA, 20 bp, mouse
gggcatggctgtcaagtccc

SEQ ID NO: 848203 - DNA, 20 bp, mouse
gagccacggcagtgtcccaa

SEQ ID NO: 848204 - DNA, 20 bp, mouse
gcagcgccgtagtgtcgccc

SEQ ID NO: 848205 - DNA, 20 bp, mouse
gcagcgagcgggttgcacgt

SEQ ID NO: 848206 - DNA, 20 bp, mouse
gtcgccgcgcagctccgaca

SEQ ID NO: 848207 - DNA, 20 bp, mouse
gcccgcccgctcgccaggga

SEQ ID NO: 848208 - DNA, 20 bp, mouse
gaggcacggggcagccacgc

SEQ ID NO: 848209 - DNA, 20 bp, mouse
gcggggtcgtccccgctctg

SEQ ID NO: 848210 - DNA, 20 bp, mouse
gcggccgcgccaggccctgt

SEQ ID NO: 848211 - DNA, 20 bp, mouse
gagctagcgaccccagagcg

SEQ ID NO: 848212 - DNA, 20 bp, mouse
ggccgggagtcagttggtct

SEQ ID NO: 848213 - DNA, 20 bp, mouse
gtctggggtcgctagctctg

SEQ ID NO: 848214 - DNA, 20 bp, mouse
gtcagggcaggcggaagcta

SEQ ID NO: 848215 - DNA, 20 bp, mouse
gcgacgccgcggtggattgt

SEQ ID NO: 848216 - DNA, 20 bp, mouse
gggctgctgtggccactcat

SEQ ID NO: 848217 - DNA, 20 bp, mouse
gaaccctggtactgtgccct

SEQ ID NO: 848218 - DNA, 20 bp, mouse
gcgcctagggcacagtacca

SEQ ID NO: 848219 - DNA, 20 bp, mouse
gcactcataggcagcgccta

SEQ ID NO: 848220 - DNA, 20 bp, mouse
gttcaccttaagtctctttg

SEQ ID NO: 848221 - DNA, 20 bp, mouse
gtgcgggcgaccgtcaatga

SEQ ID NO: 848222 - DNA, 20 bp, mouse
gaaagcagccgagcgtcgag

SEQ ID NO: 848223 - DNA, 20 bp, mouse
gactaggacctctcgacgct

SEQ ID NO: 848224 - DNA, 20 bp, mouse
gaaaaagtaggagcggagaa

SEQ ID NO: 848225 - DNA, 20 bp, mouse
gcactcgacactattacctg

SEQ ID NO: 848226 - DNA, 20 bp, mouse
gtcctccggctcagatgcca

SEQ ID NO: 848227 - DNA, 20 bp, mouse
gtaaggagggcgtgacgcag

SEQ ID NO: 848228 - DNA, 20 bp, mouse
gccagtgcagggcgtctctg

SEQ ID NO: 848229 - DNA, 20 bp, mouse
gcggcctccagggacgctca

SEQ ID NO: 848230 - DNA, 20 bp, mouse
ggcgtcacgccctccttaaa

SEQ ID NO: 848231 - DNA, 20 bp, mouse
gcttaaagggagactctgtc

SEQ ID NO: 848232 - DNA, 20 bp, mouse
gagggctccttgagcgtccc

SEQ ID NO: 848233 - DNA, 20 bp, mouse
ggctccttgagcgtccctgg

SEQ ID NO: 848234 - DNA, 20 bp, mouse
gcagagtctccctttaagga

SEQ ID NO: 848235 - DNA, 20 bp, mouse
ggctcgcaccgcccagtgca

SEQ ID NO: 848236 - DNA, 20 bp, mouse
ggagctgcgcaccgccggaa

SEQ ID NO: 848237 - DNA, 20 bp, mouse
gctcgcagcaagttggccgg

SEQ ID NO: 848238 - DNA, 20 bp, mouse
gcgcgcagacttgggtttag

SEQ ID NO: 848239 - DNA, 20 bp, mouse
ggggcagcccggagggtgaa

SEQ ID NO: 848240 - DNA, 20 bp, mouse
ggacccggacacacttccgc

SEQ ID NO: 848241 - DNA, 20 bp, mouse
gtgtccgggtccccttccgg

SEQ ID NO: 848242 - DNA, 20 bp, mouse
gcgggctgcccctcctttaa

SEQ ID NO: 848243 - DNA, 20 bp, mouse
gcccggagggtgaacggccg

SEQ ID NO: 848244 - DNA, 20 bp, mouse
gggagagctactgctctgaa

SEQ ID NO: 848245 - DNA, 20 bp, mouse
gcgccccgccgcgcagactt

SEQ ID NO: 848246 - DNA, 20 bp, mouse
ggggaaggctctgtactacg

SEQ ID NO: 848247 - DNA, 20 bp, mouse
gtggctgcgaacggcggggg

SEQ ID NO: 848248 - DNA, 20 bp, mouse
gcaagggcttctgggaagtg

SEQ ID NO: 848249 - DNA, 20 bp, mouse
gaacctccaagaggcgagat

SEQ ID NO: 848250 - DNA, 20 bp, mouse
gcatgtccggagaggtgaca

SEQ ID NO: 848251 - DNA, 20 bp, mouse
gtgggtaggtcgcgagtcta

SEQ ID NO: 848252 - DNA, 20 bp, mouse
gcccccatctcgcctcttgg

SEQ ID NO: 848253 - DNA, 20 bp, mouse
gccacaattcccggcatgtc

SEQ ID NO: 848254 - DNA, 20 bp, mouse
gtctgagcacaagggcttct

SEQ ID NO: 848255 - DNA, 20 bp, mouse
gccagcatggagcaagcgta

SEQ ID NO: 848256 - DNA, 20 bp, mouse
gcggcctccgccagactctg

SEQ ID NO: 848257 - DNA, 20 bp, mouse
gaggggcggtaccgagagag

SEQ ID NO: 848258 - DNA, 20 bp, mouse
gcaagcaccggaccctgcca

SEQ ID NO: 848259 - DNA, 20 bp, mouse
ggctgggcgagctgttggta

SEQ ID NO: 848260 - DNA, 20 bp, mouse
ggagccccagagtctggcgg

SEQ ID NO: 848261 - DNA, 20 bp, mouse
gaacctgggggtagtaaact

SEQ ID NO: 848262 - DNA, 20 bp, mouse
gaaactctaaccctctctct

SEQ ID NO: 848263 - DNA, 20 bp, mouse
ggagcccggagaggcccacc

SEQ ID NO: 848264 - DNA, 20 bp, mouse
gacaggccctcccagttaca

SEQ ID NO: 848265 - DNA, 20 bp, mouse
ggggagggcctgtatctatc

SEQ ID NO: 848266 - DNA, 20 bp, mouse
ggaaaagcccgccccagaga

SEQ ID NO: 848267 - DNA, 20 bp, mouse
gcccagagaaggccgaataa

SEQ ID NO: 848268 - DNA, 20 bp, mouse
gctaatcaggcgtgtcgctc

SEQ ID NO: 848269 - DNA, 20 bp, mouse
gataacggtgagcaattagg

SEQ ID NO: 848270 - DNA, 20 bp, mouse
gcgacagcagcgagcagacg

SEQ ID NO: 848271 - DNA, 20 bp, mouse
gcgtgacagccaccaatcaa

SEQ ID NO: 848272 - DNA, 20 bp, mouse
gttagggggatggactaatc

SEQ ID NO: 848273 - DNA, 20 bp, mouse
gcagcagggcacagcttgtc

SEQ ID NO: 848274 - DNA, 20 bp, mouse
gtggcccactaccctgttat

SEQ ID NO: 848275 - DNA, 20 bp, mouse
gggcgtgtcgctcaggcttc

SEQ ID NO: 848276 - DNA, 20 bp, mouse
ggaaagaagtgcaaattcgg

SEQ ID NO: 848277 - DNA, 20 bp, mouse
gcaggcccagcgggaaacag

SEQ ID NO: 848278 - DNA, 20 bp, mouse
gggcactttaacaggcccag

SEQ ID NO: 848279 - DNA, 20 bp, mouse
ggctgctatcactttaccat

SEQ ID NO: 848280 - DNA, 20 bp, mouse
gtgtggctagatagagggaa

SEQ ID NO: 848281 - DNA, 20 bp, mouse
ggggtaggcgatttcctggg

SEQ ID NO: 848282 - DNA, 20 bp, mouse
gttctgaaacagaccccttg

SEQ ID NO: 848283 - DNA, 20 bp, mouse
gaaggggaaagtttgtagtt

SEQ ID NO: 848284 - DNA, 20 bp, mouse
gtaggtcagggcactttaac

SEQ ID NO: 848285 - DNA, 20 bp, mouse
gacagcttggtgttgcccaa

SEQ ID NO: 848286 - DNA, 20 bp, mouse
gggccagagtagctactccc

SEQ ID NO: 848287 - DNA, 20 bp, mouse
gaaggaatgagtccagtgta

SEQ ID NO: 848288 - DNA, 20 bp, mouse
gcccacatagctgctggaaa

SEQ ID NO: 848289 - DNA, 20 bp, mouse
gaatgagtccagtgtatggc

SEQ ID NO: 848290 - DNA, 20 bp, mouse
gcacctgggagtagctactc

SEQ ID NO: 848291 - DNA, 20 bp, mouse
gcagctatgtggggggttcg

SEQ ID NO: 848292 - DNA, 20 bp, mouse
gaaggactccggactctcat

SEQ ID NO: 848293 - DNA, 20 bp, mouse
ggagggagggtgcgcctcat

SEQ ID NO: 848294 - DNA, 20 bp, mouse
gatacaaacttcaagttgga

SEQ ID NO: 848295 - DNA, 20 bp, mouse
gggggaggccagccatacac

SEQ ID NO: 848296 - DNA, 20 bp, mouse
gtcaaggggacacaccccgg

SEQ ID NO: 848297 - DNA, 20 bp, mouse
ggaagcagcaggttggagat

SEQ ID NO: 848298 - DNA, 20 bp, mouse
gacagtagcaaatatatcaa

SEQ ID NO: 848299 - DNA, 20 bp, mouse
ggacacaccccgggggaaaa

SEQ ID NO: 848300 - DNA, 20 bp, mouse
gtgggcatcaccaagcaaat

SEQ ID NO: 848301 - DNA, 20 bp, mouse
gtgcccaataagcaagcgta

SEQ ID NO: 848302 - DNA, 20 bp, mouse
ggatgcccagccgataagcc

SEQ ID NO: 848303 - DNA, 20 bp, mouse
gcctccttacgcttgcttat

SEQ ID NO: 848304 - DNA, 20 bp, mouse
gaaagaaagttgtacttgga

SEQ ID NO: 848305 - DNA, 20 bp, mouse
gttgaaacccttttcccccg

SEQ ID NO: 848306 - DNA, 20 bp, mouse
gcgcgctcagtgcaaggccg

SEQ ID NO: 848307 - DNA, 20 bp, mouse
ggagcgctggcccgccgctg

SEQ ID NO: 848308 - DNA, 20 bp, mouse
gaaggccctcctcccggtca

SEQ ID NO: 848309 - DNA, 20 bp, mouse
ggcagcccgcgctcagtgca

SEQ ID NO: 848310 - DNA, 20 bp, mouse
gggagtgcgtcccgcagcgg

SEQ ID NO: 848311 - DNA, 20 bp, mouse
gaggtagcggccgtgagcgc

SEQ ID NO: 848312 - DNA, 20 bp, mouse
gtgcgacgatctcagtcccg

SEQ ID NO: 848313 - DNA, 20 bp, mouse
gtggccccctcccgcctctc

SEQ ID NO: 848314 - DNA, 20 bp, mouse
gggaggatctgcccttgaaa

SEQ ID NO: 848315 - DNA, 20 bp, mouse
gggactgagatcgtcgcaca

SEQ ID NO: 848316 - DNA, 20 bp, mouse
gaggttgtatggagaagccc

SEQ ID NO: 848317 - DNA, 20 bp, mouse
gaagcctgtggggaccacgc

SEQ ID NO: 848318 - DNA, 20 bp, mouse
gcctctgatgaagacaagaa

SEQ ID NO: 848319 - DNA, 20 bp, mouse
gctgggagttcaccttgccc

SEQ ID NO: 848320 - DNA, 20 bp, mouse
gctgatgaagacaagaaggg

SEQ ID NO: 848321 - DNA, 20 bp, mouse
gcttcctgcgtggtccccac

SEQ ID NO: 848322 - DNA, 20 bp, mouse
gctgacaagtccagcaggaa

SEQ ID NO: 848323 - DNA, 20 bp, mouse
gacgcaggaagacttccttc

SEQ ID NO: 848324 - DNA, 20 bp, mouse
gacaaatgtgggaggtgcca

SEQ ID NO: 848325 - DNA, 20 bp, mouse
gggagaaaggagacaaatgt

SEQ ID NO: 848326 - DNA, 20 bp, mouse
gaagcccagcaactttccta

SEQ ID NO: 848327 - DNA, 20 bp, mouse
gaagttgctgggcttgtggt

SEQ ID NO: 848328 - DNA, 20 bp, mouse
gaagggcttctgataccgat

SEQ ID NO: 848329 - DNA, 20 bp, mouse
gtgggaagagaatctctata

SEQ ID NO: 848330 - DNA, 20 bp, mouse
gcagagattgcaggggggtt

SEQ ID NO: 848331 - DNA, 20 bp, mouse
gcctctgggaatggagaagt

SEQ ID NO: 848332 - DNA, 20 bp, mouse
ggaaaagcttcagagattgc

SEQ ID NO: 848333 - DNA, 20 bp, mouse
gagcttcagagattgcaggg

SEQ ID NO: 848334 - DNA, 20 bp, mouse
gtgcggtgtgagtctctcca

SEQ ID NO: 848335 - DNA, 20 bp, mouse
ggccaataatgatgtgacct

SEQ ID NO: 848336 - DNA, 20 bp, mouse
gtgggaccagtggtgctctc

SEQ ID NO: 848337 - DNA, 20 bp, mouse
gttactttctggtcagtcta

SEQ ID NO: 848338 - DNA, 20 bp, mouse
gtgagcagactcaaaattct

SEQ ID NO: 848339 - DNA, 20 bp, mouse
gaaagtaaaacatccctcta

SEQ ID NO: 848340 - DNA, 20 bp, mouse
gctaggatttgactttctct

SEQ ID NO: 848341 - DNA, 20 bp, mouse
ggcgtaaggttagagattta

SEQ ID NO: 848342 - DNA, 20 bp, mouse
gggaagtgtgtgaggaaact

SEQ ID NO: 848343 - DNA, 20 bp, mouse
gctagggaaaccatttgttc

SEQ ID NO: 848344 - DNA, 20 bp, mouse
gaaggttagagatttaagga

SEQ ID NO: 848345 - DNA, 20 bp, mouse
ggtcaaatcctagtagaatg

SEQ ID NO: 848346 - DNA, 20 bp, mouse
gggtccccctgcactactct

SEQ ID NO: 848347 - DNA, 20 bp, mouse
gtccgtggacgctagaaaat

SEQ ID NO: 848348 - DNA, 20 bp, mouse
gctgtcccaagagtagtgca

SEQ ID NO: 848349 - DNA, 20 bp, mouse
gacagggaagagcttgggtg

SEQ ID NO: 848350 - DNA, 20 bp, mouse
gagtggcgagaggagctccg

SEQ ID NO: 848351 - DNA, 20 bp, mouse
gggagggtgcatgagactca

SEQ ID NO: 848352 - DNA, 20 bp, mouse
ggggcctggtccccgccttg

SEQ ID NO: 848353 - DNA, 20 bp, mouse
gcctcctggccaagtcctcg

SEQ ID NO: 848354 - DNA, 20 bp, mouse
gaccagcgggacttgtaatt

SEQ ID NO: 848355 - DNA, 20 bp, mouse
gtgagggctgggtaatgcct

SEQ ID NO: 848356 - DNA, 20 bp, mouse
gctaggatgggcatgagata

SEQ ID NO: 848357 - DNA, 20 bp, mouse
gctgcgaagcggcaggagga

SEQ ID NO: 848358 - DNA, 20 bp, mouse
gagggtggagagagaaacga

SEQ ID NO: 848359 - DNA, 20 bp, mouse
gccagcccctgctctaggat

SEQ ID NO: 848360 - DNA, 20 bp, mouse
gaccaaaagccgcttggcga

SEQ ID NO: 848361 - DNA, 20 bp, mouse
gccttggccccagaatctca

SEQ ID NO: 848362 - DNA, 20 bp, mouse
gagaggagacaagaacacgt

SEQ ID NO: 848363 - DNA, 20 bp, mouse
gtggcgcatgctcagatgca

SEQ ID NO: 848364 - DNA, 20 bp, mouse
gcatgcccatcctagagcag

SEQ ID NO: 848365 - DNA, 20 bp, mouse
gagcatgcgccatcgccaag

SEQ ID NO: 848366 - DNA, 20 bp, mouse
gcgcccgctccactcgccgc

SEQ ID NO: 848367 - DNA, 20 bp, mouse
ggagcccgcggcgagtggag

SEQ ID NO: 848368 - DNA, 20 bp, mouse
gcaagccgagcgactgacgt

SEQ ID NO: 848369 - DNA, 20 bp, mouse
gcccacgcccagcgagcccg

SEQ ID NO: 848370 - DNA, 20 bp, mouse
gcactcgccgcgggctcgct

SEQ ID NO: 848371 - DNA, 20 bp, mouse
gagcggaagcagccagccgg

SEQ ID NO: 848372 - DNA, 20 bp, mouse
gccggcgctcagagagttaa

SEQ ID NO: 848373 - DNA, 20 bp, mouse
gactgcgcacctgccggccg

SEQ ID NO: 848374 - DNA, 20 bp, mouse
gcggcggcggagacacttca

SEQ ID NO: 848375 - DNA, 20 bp, mouse
ggggacgaactgccaggtag

SEQ ID NO: 848376 - DNA, 20 bp, mouse
gggacgacggggtaggggcg

SEQ ID NO: 848377 - DNA, 20 bp, mouse
ggggcggggcggactccgag

SEQ ID NO: 848378 - DNA, 20 bp, mouse
gaggtgggggacgacggggt

SEQ ID NO: 848379 - DNA, 20 bp, mouse
ggctacgaatgaccccgcgg

SEQ ID NO: 848380 - DNA, 20 bp, mouse
gcccgagagaggcggggaaa

SEQ ID NO: 848381 - DNA, 20 bp, mouse
ggactccgagaggagggcgg

SEQ ID NO: 848382 - DNA, 20 bp, mouse
ggcggactccgagaggaggg

SEQ ID NO: 848383 - DNA, 20 bp, mouse
ggcgggaggtgggggacgac

SEQ ID NO: 848384 - DNA, 20 bp, mouse
ggaatggagggggcggtcag

SEQ ID NO: 848385 - DNA, 20 bp, mouse
gagcaaagcagacgcggggt

SEQ ID NO: 848386 - DNA, 20 bp, mouse
ggcctcccgcgcgggagcgg

SEQ ID NO: 848387 - DNA, 20 bp, mouse
ggggcggaacactagggtgt

SEQ ID NO: 848388 - DNA, 20 bp, mouse
gtatcatcaaagttttgccc

SEQ ID NO: 848389 - DNA, 20 bp, mouse
gcccgcagggcggaacacta

SEQ ID NO: 848390 - DNA, 20 bp, mouse
gaggtgcaggacaggtgaat

SEQ ID NO: 848391 - DNA, 20 bp, mouse
ggcgggggtggggcaggccc

SEQ ID NO: 848392 - DNA, 20 bp, mouse
gcagaagcagtgtgtgtcgg

SEQ ID NO: 848393 - DNA, 20 bp, mouse
gcgcaactggcctcccgcgc

SEQ ID NO: 848394 - DNA, 20 bp, mouse
ggctcagggcggggagcgag

SEQ ID NO: 848395 - DNA, 20 bp, mouse
gcgcacccgggatgagacat

SEQ ID NO: 848396 - DNA, 20 bp, mouse
gtggtgaaaggggacaccgt

SEQ ID NO: 848397 - DNA, 20 bp, mouse
gggctggcccagttagtgga

SEQ ID NO: 848398 - DNA, 20 bp, mouse
gcaggaggacgttgtaacgt

SEQ ID NO: 848399 - DNA, 20 bp, mouse
ggtacagagctaaggcgtcc

SEQ ID NO: 848400 - DNA, 20 bp, mouse
gaacccagtacctaagtttc

SEQ ID NO: 848401 - DNA, 20 bp, mouse
ggtaacgttggacgttgtcc

SEQ ID NO: 848402 - DNA, 20 bp, mouse
ggacgtgggcgtggtgaaag

SEQ ID NO: 848403 - DNA, 20 bp, mouse
gtgtacaacgtgaatctcca

SEQ ID NO: 848404 - DNA, 20 bp, mouse
gctacgccgagctggaggag

SEQ ID NO: 848405 - DNA, 20 bp, mouse
gcaactgatggaagactcag

SEQ ID NO: 848406 - DNA, 20 bp, mouse
gtgcaaagatatggggtaat

SEQ ID NO: 848407 - DNA, 20 bp, mouse
ggaaacagatagggtgactc

SEQ ID NO: 848408 - DNA, 20 bp, mouse
gtgggaaggcacgcactcag

SEQ ID NO: 848409 - DNA, 20 bp, mouse
gtataaatatgcaaagatat

SEQ ID NO: 848410 - DNA, 20 bp, mouse
gagtgctagctgctgttcaa

SEQ ID NO: 848411 - DNA, 20 bp, mouse
gcctgcagctgctccgccag

SEQ ID NO: 848412 - DNA, 20 bp, mouse
gccgccagaggcagatgagc

SEQ ID NO: 848413 - DNA, 20 bp, mouse
ggagtgaggggaaacagata

SEQ ID NO: 848414 - DNA, 20 bp, mouse
gagtgcagggaggtgactgg

SEQ ID NO: 848415 - DNA, 20 bp, mouse
ggaaccttgaattgataaag

SEQ ID NO: 848416 - DNA, 20 bp, mouse
ggctgggaggccaacaactc

SEQ ID NO: 848417 - DNA, 20 bp, mouse
gaggccaacaactcagggga

SEQ ID NO: 848418 - DNA, 20 bp, mouse
gcgttccagagaatggaggt

SEQ ID NO: 848419 - DNA, 20 bp, mouse
gtaggaagactgcagctggg

SEQ ID NO: 848420 - DNA, 20 bp, mouse
gttgtgggtttcataggaga

SEQ ID NO: 848421 - DNA, 20 bp, mouse
gtggaacttgtgggtttcat

SEQ ID NO: 848422 - DNA, 20 bp, mouse
gggctaggaagactgcagct

SEQ ID NO: 848423 - DNA, 20 bp, mouse
ggaagaaaagtgagcaacaa

SEQ ID NO: 848424 - DNA, 20 bp, mouse
gctcccctcccctgagttgt

SEQ ID NO: 848425 - DNA, 20 bp, mouse
gggcgcctgaacctgctggt

SEQ ID NO: 848426 - DNA, 20 bp, mouse
ggcgacagatccctggggta

SEQ ID NO: 848427 - DNA, 20 bp, mouse
gcagcaggcccaagtgtggt

SEQ ID NO: 848428 - DNA, 20 bp, mouse
gcgccctggcccctcgatac

SEQ ID NO: 848429 - DNA, 20 bp, mouse
gggcgcagcaggcccaagtg

SEQ ID NO: 848430 - DNA, 20 bp, mouse
gccgccgccaccggtatcga

SEQ ID NO: 848431 - DNA, 20 bp, mouse
gtagctgcgacagatccctg

SEQ ID NO: 848432 - DNA, 20 bp, mouse
gcaccggtatcgaggggcca

SEQ ID NO: 848433 - DNA, 20 bp, mouse
gctggctgggaccagtgcct

SEQ ID NO: 848434 - DNA, 20 bp, mouse
gggactggataaggatagga

SEQ ID NO: 848435 - DNA, 20 bp, mouse
gcaagtgtggtgggctctgc

SEQ ID NO: 848436 - DNA, 20 bp, mouse
gctggagccgtgtgcgacac

SEQ ID NO: 848437 - DNA, 20 bp, mouse
gcggacaagcgtctcagcaa

SEQ ID NO: 848438 - DNA, 20 bp, mouse
ggtccgcgacgggtgcccga

SEQ ID NO: 848439 - DNA, 20 bp, mouse
gtgctggtaagcggagatag

SEQ ID NO: 848440 - DNA, 20 bp, mouse
gacgcatgagataaagagag

SEQ ID NO: 848441 - DNA, 20 bp, mouse
gaagcggaagtatctgtgac

SEQ ID NO: 848442 - DNA, 20 bp, mouse
ggtctcagcaacggatgcgt

SEQ ID NO: 848443 - DNA, 20 bp, mouse
gcatgagataaagagagggg

SEQ ID NO: 848444 - DNA, 20 bp, mouse
gagcgctctctgctggtaag

SEQ ID NO: 848445 - DNA, 20 bp, mouse
gcggctccagcgctctctgc

SEQ ID NO: 848446 - DNA, 20 bp, mouse
gtaggccctgacctgtgaaa

SEQ ID NO: 848447 - DNA, 20 bp, mouse
gtcggggcttgaattcatac

SEQ ID NO: 848448 - DNA, 20 bp, mouse
gaagccccgaggtagagact

SEQ ID NO: 848449 - DNA, 20 bp, mouse
gcctgacctgtgaaagggtg

SEQ ID NO: 848450 - DNA, 20 bp, mouse
gtttcccagtctctacctcg

SEQ ID NO: 848451 - DNA, 20 bp, mouse
gctccgtgaagccaaggccc

SEQ ID NO: 848452 - DNA, 20 bp, mouse
gggaggggtgcatgtagctg

SEQ ID NO: 848453 - DNA, 20 bp, mouse
gaggaattccaggaagctgc

SEQ ID NO: 848454 - DNA, 20 bp, mouse
gaacgtagagaatgattcta

SEQ ID NO: 848455 - DNA, 20 bp, mouse
gcaacctagtctgctgtctc

SEQ ID NO: 848456 - DNA, 20 bp, mouse
ggccgcgcaccgaccggaag

SEQ ID NO: 848457 - DNA, 20 bp, mouse
ggtgatacccgagagcatgt

SEQ ID NO: 848458 - DNA, 20 bp, mouse
gtaaagaaaaagttcacttt

SEQ ID NO: 848459 - DNA, 20 bp, mouse
ggcaggcgcgggctttccga

SEQ ID NO: 848460 - DNA, 20 bp, mouse
gcttgcgccgaggacccgag

SEQ ID NO: 848461 - DNA, 20 bp, mouse
ggacccgagcgggaggctca

SEQ ID NO: 848462 - DNA, 20 bp, mouse
gagcctcccgctcgggtcct

SEQ ID NO: 848463 - DNA, 20 bp, mouse
gggcgctccagccgtttctc

SEQ ID NO: 848464 - DNA, 20 bp, mouse
gccgccgtgagcctcccgct

SEQ ID NO: 848465 - DNA, 20 bp, mouse
gcgccacagccacttccggt

SEQ ID NO: 848466 - DNA, 20 bp, mouse
ggccgaggcgccagtcccgc

SEQ ID NO: 848467 - DNA, 20 bp, mouse
gagaacccggggcagcctaa

SEQ ID NO: 848468 - DNA, 20 bp, mouse
gcgacctggagacaaacagt

SEQ ID NO: 848469 - DNA, 20 bp, mouse
ggtctcgcgccaagacgagc

SEQ ID NO: 848470 - DNA, 20 bp, mouse
ggcctctgctcatctatcta

SEQ ID NO: 848471 - DNA, 20 bp, mouse
gggaactgcgatgacagcga

SEQ ID NO: 848472 - DNA, 20 bp, mouse
gcgagccggtggctccgacc

SEQ ID NO: 848473 - DNA, 20 bp, mouse
ggaggacggccgtgcaggga

SEQ ID NO: 848474 - DNA, 20 bp, mouse
gccggcgggcccggatgagg

SEQ ID NO: 848475 - DNA, 20 bp, mouse
gctgacaagaagccggggcg

SEQ ID NO: 848476 - DNA, 20 bp, mouse
gccaaagtcagtagggtcac

SEQ ID NO: 848477 - DNA, 20 bp, mouse
ggccaagaccaaagtcagta

SEQ ID NO: 848478 - DNA, 20 bp, mouse
gtcagggagattaacgggac

SEQ ID NO: 848479 - DNA, 20 bp, mouse
gattaacgggactggctcag

SEQ ID NO: 848480 - DNA, 20 bp, mouse
gctgactttggtcttggcga

SEQ ID NO: 848481 - DNA, 20 bp, mouse
gaatctctcaacacctgatg

SEQ ID NO: 848482 - DNA, 20 bp, mouse
gagtcagtagggtcacgggc

SEQ ID NO: 848483 - DNA, 20 bp, mouse
gtcgaagcggggggtaggat

SEQ ID NO: 848484 - DNA, 20 bp, mouse
gaagctgggtgttacagcat

SEQ ID NO: 848485 - DNA, 20 bp, mouse
gccagaggatgagcaaataa

SEQ ID NO: 848486 - DNA, 20 bp, mouse
ggaaccctaaggagtagggg

SEQ ID NO: 848487 - DNA, 20 bp, mouse
gcgcaagtccgggaccgcta

SEQ ID NO: 848488 - DNA, 20 bp, mouse
gcacaaaggcatataggtgt

SEQ ID NO: 848489 - DNA, 20 bp, mouse
ggggcctgactcacggtagg

SEQ ID NO: 848490 - DNA, 20 bp, mouse
gccgcctgcaaaagagagat

SEQ ID NO: 848491 - DNA, 20 bp, mouse
gagtgggtgtggcttctccg

SEQ ID NO: 848492 - DNA, 20 bp, mouse
gcactcagtcgctcgcgcag

SEQ ID NO: 848493 - DNA, 20 bp, mouse
ggggggaaccctaaggagta

SEQ ID NO: 848494 - DNA, 20 bp, mouse
ggtgggtggggcctgactca

SEQ ID NO: 848495 - DNA, 20 bp, mouse
gtcctcctcccctactcctt

SEQ ID NO: 848496 - DNA, 20 bp, mouse
gagccgcagcgccccccgaa

SEQ ID NO: 848497 - DNA, 20 bp, mouse
ggggtcgccgggcagggcga

SEQ ID NO: 848498 - DNA, 20 bp, mouse
gtaggctgggctccgttcgg

SEQ ID NO: 848499 - DNA, 20 bp, mouse
gctgcggctcgcagccacgt

SEQ ID NO: 848500 - DNA, 20 bp, mouse
ggctgctctgcccgcggcgt

SEQ ID NO: 848501 - DNA, 20 bp, mouse
ggaccaacaggtgccccacg

SEQ ID NO: 848502 - DNA, 20 bp, mouse
gcggcgcaactattgctcca

SEQ ID NO: 848503 - DNA, 20 bp, mouse
gctcacaggctgcatccgag

SEQ ID NO: 848504 - DNA, 20 bp, mouse
gtccgtgggtcgtgggtcgc

SEQ ID NO: 848505 - DNA, 20 bp, mouse
gcccagttgttggaaggcgt

SEQ ID NO: 848506 - DNA, 20 bp, mouse
ggctcaccccagggataaag

SEQ ID NO: 848507 - DNA, 20 bp, mouse
ggctgcttcccaatcctcag

SEQ ID NO: 848508 - DNA, 20 bp, mouse
gactgcaccacgccagcttg

SEQ ID NO: 848509 - DNA, 20 bp, mouse
gtcaggggaactgaagagga

SEQ ID NO: 848510 - DNA, 20 bp, mouse
ggtcacatcctgcctttatc

SEQ ID NO: 848511 - DNA, 20 bp, mouse
gtgcactgcagcacaatccc

SEQ ID NO: 848512 - DNA, 20 bp, mouse
gggtgctgccagatctccta

SEQ ID NO: 848513 - DNA, 20 bp, mouse
gaaggagcccctttatccct

SEQ ID NO: 848514 - DNA, 20 bp, mouse
gactgaagaggaaggctctt

SEQ ID NO: 848515 - DNA, 20 bp, mouse
gccggccacaagaaggcagc

SEQ ID NO: 848516 - DNA, 20 bp, mouse
gccagagcttaggggagtca

SEQ ID NO: 848517 - DNA, 20 bp, mouse
gtcctctcaaacagggctct

SEQ ID NO: 848518 - DNA, 20 bp, mouse
gagaattcccccatttgcag

SEQ ID NO: 848519 - DNA, 20 bp, mouse
gctagagtaaatgatgtctc

SEQ ID NO: 848520 - DNA, 20 bp, mouse
ggctttcagagtaacagcgg

SEQ ID NO: 848521 - DNA, 20 bp, mouse
gttcagagtaacagcggggg

SEQ ID NO: 848522 - DNA, 20 bp, mouse
gccatgggtgggataaaaat

SEQ ID NO: 848523 - DNA, 20 bp, mouse
gctaaggggcgtttatcaat

SEQ ID NO: 848524 - DNA, 20 bp, mouse
ggccaagagccctgtttgag

SEQ ID NO: 848525 - DNA, 20 bp, mouse
gaggcaggcaatgactggag

SEQ ID NO: 848526 - DNA, 20 bp, mouse
gtcagagtagactatgcaga

SEQ ID NO: 848527 - DNA, 20 bp, mouse
gtatagctggtccctagaag

SEQ ID NO: 848528 - DNA, 20 bp, mouse
ggtagaagatttgtttttca

SEQ ID NO: 848529 - DNA, 20 bp, mouse
ggaagacccacccccttcta

SEQ ID NO: 848530 - DNA, 20 bp, mouse
gttacacttgtaggaggaca

SEQ ID NO: 848531 - DNA, 20 bp, mouse
ggctataaagttacacttgt

SEQ ID NO: 848532 - DNA, 20 bp, mouse
ggtacaaactcagggatatt

SEQ ID NO: 848533 - DNA, 20 bp, mouse
gtatgccaggtacaaactca

SEQ ID NO: 848534 - DNA, 20 bp, mouse
gagaaattcactatttcatt

SEQ ID NO: 848535 - DNA, 20 bp, mouse
ggctggtccctagaaggggg

SEQ ID NO: 848536 - DNA, 20 bp, mouse
gggggctgatagcaaatgtc

SEQ ID NO: 848537 - DNA, 20 bp, mouse
gaagcaggaggccacttagc

SEQ ID NO: 848538 - DNA, 20 bp, mouse
gagggagggcgcaggatggg

SEQ ID NO: 848539 - DNA, 20 bp, mouse
gacaacactgggatctgggg

SEQ ID NO: 848540 - DNA, 20 bp, mouse
gggaagggagggcgcaggat

SEQ ID NO: 848541 - DNA, 20 bp, mouse
gcccaaaagcctgatgcccc

SEQ ID NO: 848542 - DNA, 20 bp, mouse
gctggaagggagcacctcta

SEQ ID NO: 848543 - DNA, 20 bp, mouse
gcaagtgacttattccccct

SEQ ID NO: 848544 - DNA, 20 bp, mouse
gggtccagtcaggaccttga

SEQ ID NO: 848545 - DNA, 20 bp, mouse
ggtgctggacagagccctca

SEQ ID NO: 848546 - DNA, 20 bp, mouse
ggggtaagccagcaacaccg

SEQ ID NO: 848547 - DNA, 20 bp, mouse
gccgggctccccggtgttgc

SEQ ID NO: 848548 - DNA, 20 bp, mouse
gttgaactgtcccacttcca

SEQ ID NO: 848549 - DNA, 20 bp, mouse
gcagagggctctgaggaaat

SEQ ID NO: 848550 - DNA, 20 bp, mouse
gctggcttaccccaagcacc

SEQ ID NO: 848551 - DNA, 20 bp, mouse
gctcttaaggccccgctcaa

SEQ ID NO: 848552 - DNA, 20 bp, mouse
gagccaccactgaaaggtcc

SEQ ID NO: 848553 - DNA, 20 bp, mouse
ggggtcacacattcatatgc

SEQ ID NO: 848554 - DNA, 20 bp, mouse
gccaagcttctagaactcaa

SEQ ID NO: 848555 - DNA, 20 bp, mouse
gagatttcctccaggtgctt

SEQ ID NO: 848556 - DNA, 20 bp, mouse
gtccgcgcgtcagctcaggc

SEQ ID NO: 848557 - DNA, 20 bp, mouse
ggaggcggtgcggtgcccga

SEQ ID NO: 848558 - DNA, 20 bp, mouse
ggccccgcccgccactgcgg

SEQ ID NO: 848559 - DNA, 20 bp, mouse
gcgtgcagtggctggggtac

SEQ ID NO: 848560 - DNA, 20 bp, mouse
ggtactggctctctgcactg

SEQ ID NO: 848561 - DNA, 20 bp, mouse
gccccctccgcagtggcggg

SEQ ID NO: 848562 - DNA, 20 bp, mouse
gagcgggagtccacccaggg

SEQ ID NO: 848563 - DNA, 20 bp, mouse
gactgcacgacccccaccaa

SEQ ID NO: 848564 - DNA, 20 bp, mouse
gtctgccccgcccgccactg

SEQ ID NO: 848565 - DNA, 20 bp, mouse
gggaacgccgctgcagtgat

SEQ ID NO: 848566 - DNA, 20 bp, mouse
ggcagtgaggtgaactgggg

SEQ ID NO: 848567 - DNA, 20 bp, mouse
gctgctgcccaccaggacca

SEQ ID NO: 848568 - DNA, 20 bp, mouse
ggtgggcagggggcgtacag

SEQ ID NO: 848569 - DNA, 20 bp, mouse
ggcaactgggggtgcaaaag

SEQ ID NO: 848570 - DNA, 20 bp, mouse
gtctgtgtggtgtgggcagg

SEQ ID NO: 848571 - DNA, 20 bp, mouse
ggcctgacctagggcttccc

SEQ ID NO: 848572 - DNA, 20 bp, mouse
gtcctgcctggccctggtcc

SEQ ID NO: 848573 - DNA, 20 bp, mouse
gccccagtgttccatcaaca

SEQ ID NO: 848574 - DNA, 20 bp, mouse
gcagcaggatgcgtctgcct

SEQ ID NO: 848575 - DNA, 20 bp, mouse
gagtgcagtgaggtgaactg

SEQ ID NO: 848576 - DNA, 20 bp, mouse
gccagctccgggcgtccctg

SEQ ID NO: 848577 - DNA, 20 bp, mouse
gcccaggcgtggtcgcccca

SEQ ID NO: 848578 - DNA, 20 bp, mouse
ggagcccggcgcgccgcccc

SEQ ID NO: 848579 - DNA, 20 bp, mouse
ggagcgccagccggtaggat

SEQ ID NO: 848580 - DNA, 20 bp, mouse
gtccctggggcgaccacgcc

SEQ ID NO: 848581 - DNA, 20 bp, mouse
gtggtcgccccagggacgcc

SEQ ID NO: 848582 - DNA, 20 bp, mouse
gctccggtagccgatcctac

SEQ ID NO: 848583 - DNA, 20 bp, mouse
gaggccgagcgccagccggt

SEQ ID NO: 848584 - DNA, 20 bp, mouse
gtcgccgggctctgcgggat

SEQ ID NO: 848585 - DNA, 20 bp, mouse
gggatgggcccggcccgggg

SEQ ID NO: 848586 - DNA, 20 bp, mouse
gggagggaggcacccagaat

SEQ ID NO: 848587 - DNA, 20 bp, mouse
gtcagcctgggaggaaattg

SEQ ID NO: 848588 - DNA, 20 bp, mouse
gggagccccaatttcctccc

SEQ ID NO: 848589 - DNA, 20 bp, mouse
gcggaggcagcgaatagcgt

SEQ ID NO: 848590 - DNA, 20 bp, mouse
gccagaatggggtaagacaa

SEQ ID NO: 848591 - DNA, 20 bp, mouse
ggggccagaaaccccccgca

SEQ ID NO: 848592 - DNA, 20 bp, mouse
gtggctctcccgggacgcta

SEQ ID NO: 848593 - DNA, 20 bp, mouse
gcgccatagccggaacttaa

SEQ ID NO: 848594 - DNA, 20 bp, mouse
ggaggaaattggggctccgt

SEQ ID NO: 848595 - DNA, 20 bp, mouse
ggcgacataagggaacccgg

SEQ ID NO: 848596 - DNA, 20 bp, mouse
ggggccaatgggattcaggc

SEQ ID NO: 848597 - DNA, 20 bp, mouse
ggcctcgtgagcgtgggcag

SEQ ID NO: 848598 - DNA, 20 bp, mouse
gggcagggcaacgccagccc

SEQ ID NO: 848599 - DNA, 20 bp, mouse
gctgagtgagcctgacaggt

SEQ ID NO: 848600 - DNA, 20 bp, mouse
gggcgacgcctcgtgagcgt

SEQ ID NO: 848601 - DNA, 20 bp, mouse
gaagcctgagtgagcctgac

SEQ ID NO: 848602 - DNA, 20 bp, mouse
ggcgttgccctgccctcggt

SEQ ID NO: 848603 - DNA, 20 bp, mouse
ggaggcgtcgccaccagggc

SEQ ID NO: 848604 - DNA, 20 bp, mouse
gccgagggccaatgggattc

SEQ ID NO: 848605 - DNA, 20 bp, mouse
gctcacgaggcgtcgccacc

SEQ ID NO: 848606 - DNA, 20 bp, mouse
gccactgcaggagaccctcg

SEQ ID NO: 848607 - DNA, 20 bp, mouse
gaatacacagcaagccaagt

SEQ ID NO: 848608 - DNA, 20 bp, mouse
ggggcaacttgcccagtgtc

SEQ ID NO: 848609 - DNA, 20 bp, mouse
gccaagttggagaaaaacac

SEQ ID NO: 848610 - DNA, 20 bp, mouse
gttaacgagctggacgccgg

SEQ ID NO: 848611 - DNA, 20 bp, mouse
ggcagcaagtcgggcgggtg

SEQ ID NO: 848612 - DNA, 20 bp, mouse
gagaaaaacaccggccgcga

SEQ ID NO: 848613 - DNA, 20 bp, mouse
gcagtgtctggtatataacg

SEQ ID NO: 848614 - DNA, 20 bp, mouse
ggggcggcgccgggtcggga

SEQ ID NO: 848615 - DNA, 20 bp, mouse
gtccagctcgttaatctaga

SEQ ID NO: 848616 - DNA, 20 bp, mouse
ggggctcagaagccagttgt

SEQ ID NO: 848617 - DNA, 20 bp, mouse
gcgagcatggggtgtgtgtc

SEQ ID NO: 848618 - DNA, 20 bp, mouse
gcaggctgtagtgttgtcta

SEQ ID NO: 848619 - DNA, 20 bp, mouse
gtggtccgcggaagcagctg

SEQ ID NO: 848620 - DNA, 20 bp, mouse
gaaacccccagctgcttccg

SEQ ID NO: 848621 - DNA, 20 bp, mouse
ggcagatggcttaaatctaa

SEQ ID NO: 848622 - DNA, 20 bp, mouse
gaacactacagcctggtccg

SEQ ID NO: 848623 - DNA, 20 bp, mouse
gcagttgttggcgctgtccg

SEQ ID NO: 848624 - DNA, 20 bp, mouse
gaaatctaaaggcaagtccc

SEQ ID NO: 848625 - DNA, 20 bp, mouse
gtgcagagatgaaagttcca

SEQ ID NO: 848626 - DNA, 20 bp, mouse
gccgccggtgcctctccggg

SEQ ID NO: 848627 - DNA, 20 bp, mouse
gccgcccgccggtgcctctc

SEQ ID NO: 848628 - DNA, 20 bp, mouse
gcaaagatcagggaccccga

SEQ ID NO: 848629 - DNA, 20 bp, mouse
gtggggcgggagcaaagatc

SEQ ID NO: 848630 - DNA, 20 bp, mouse
gcacacccccagcctgggtt

SEQ ID NO: 848631 - DNA, 20 bp, mouse
gtccgggaggcgtggagcct

SEQ ID NO: 848632 - DNA, 20 bp, mouse
gtgaaggcttcgaaccaagt

SEQ ID NO: 848633 - DNA, 20 bp, mouse
gggtaaggatagtgtattgg

SEQ ID NO: 848634 - DNA, 20 bp, mouse
gctacctgctgggagtcaaa

SEQ ID NO: 848635 - DNA, 20 bp, mouse
gttgtggacactcaaaccca

SEQ ID NO: 848636 - DNA, 20 bp, mouse
gccgggttgggaggagtcta

SEQ ID NO: 848637 - DNA, 20 bp, mouse
gccacgcccaagctgtccac

SEQ ID NO: 848638 - DNA, 20 bp, mouse
gccagtatttaaggggtcaa

SEQ ID NO: 848639 - DNA, 20 bp, mouse
gttaatgcagatgacatcct

SEQ ID NO: 848640 - DNA, 20 bp, mouse
ggagtctagggctggctcta

SEQ ID NO: 848641 - DNA, 20 bp, mouse
gtgcattaacatagccttct

SEQ ID NO: 848642 - DNA, 20 bp, mouse
ggcgtggctttcagagaggt

SEQ ID NO: 848643 - DNA, 20 bp, mouse
gttagcctcccgaatagtct

SEQ ID NO: 848644 - DNA, 20 bp, mouse
ggttgggaggagtctagggc

SEQ ID NO: 848645 - DNA, 20 bp, mouse
ggataccttcggttagcctc

SEQ ID NO: 848646 - DNA, 20 bp, mouse
gtcccatgacagcctggtcc

SEQ ID NO: 848647 - DNA, 20 bp, mouse
ggctgcctaaaggggcactc

SEQ ID NO: 848648 - DNA, 20 bp, mouse
gaaggcttgaaaagccagga

SEQ ID NO: 848649 - DNA, 20 bp, mouse
gtggtcctggctgcctaaag

SEQ ID NO: 848650 - DNA, 20 bp, mouse
gtgagctgtggtggtgtttg

SEQ ID NO: 848651 - DNA, 20 bp, mouse
gaggcaggaaggtctctatg

SEQ ID NO: 848652 - DNA, 20 bp, mouse
gggtaattaagagaaggcca

SEQ ID NO: 848653 - DNA, 20 bp, mouse
gggggcactcagggtgtctc

SEQ ID NO: 848654 - DNA, 20 bp, mouse
ggcctggaccaggctgtcat

SEQ ID NO: 848655 - DNA, 20 bp, mouse
gtacctgtgggtgacggggc

SEQ ID NO: 848656 - DNA, 20 bp, mouse
ggagcctcggcgggccgcga

SEQ ID NO: 848657 - DNA, 20 bp, mouse
ggacggaagtcacactcggc

SEQ ID NO: 848658 - DNA, 20 bp, mouse
ggcccctcgggctccgtgcg

SEQ ID NO: 848659 - DNA, 20 bp, mouse
gaggaaagcagcaaccggaa

SEQ ID NO: 848660 - DNA, 20 bp, mouse
gcccagaggcgctacggcgg

SEQ ID NO: 848661 - DNA, 20 bp, mouse
gggtcggaaagcccctaatt

SEQ ID NO: 848662 - DNA, 20 bp, mouse
gcacaggagtcgccgtagga

SEQ ID NO: 848663 - DNA, 20 bp, mouse
gaggctccgcgaccaccgtc

SEQ ID NO: 848664 - DNA, 20 bp, mouse
gcccacggttctcttcccga

SEQ ID NO: 848665 - DNA, 20 bp, mouse
ggacacggccgcctcgcgga

SEQ ID NO: 848666 - DNA, 20 bp, mouse
gggctggcacagctctagat

SEQ ID NO: 848667 - DNA, 20 bp, mouse
gggaacaagggccacaatgg

SEQ ID NO: 848668 - DNA, 20 bp, mouse
gacccacaggaggaagactt

SEQ ID NO: 848669 - DNA, 20 bp, mouse
gcgagtccgggctacatctg

SEQ ID NO: 848670 - DNA, 20 bp, mouse
gtctctctgtgtggccaaga

SEQ ID NO: 848671 - DNA, 20 bp, mouse
gggctacaacacttccttct

SEQ ID NO: 848672 - DNA, 20 bp, mouse
gttggccacacagagagagc

SEQ ID NO: 848673 - DNA, 20 bp, mouse
gcatttaaaggacccacagg

SEQ ID NO: 848674 - DNA, 20 bp, mouse
gatgcatttaaaggacccac

SEQ ID NO: 848675 - DNA, 20 bp, mouse
gaagtgtcactttgagtggt

SEQ ID NO: 848676 - DNA, 20 bp, mouse
gaaggctcgcggcacagtgc

SEQ ID NO: 848677 - DNA, 20 bp, mouse
gcacgcggtccgaccaatgg

SEQ ID NO: 848678 - DNA, 20 bp, mouse
gcggagctggcgaacggtat

SEQ ID NO: 848679 - DNA, 20 bp, mouse
gacaccggagggtccctgga

SEQ ID NO: 848680 - DNA, 20 bp, mouse
gacgcgccggctaccaccat

SEQ ID NO: 848681 - DNA, 20 bp, mouse
gtggcgaacggtataggttc

SEQ ID NO: 848682 - DNA, 20 bp, mouse
gcgtggctaggaactgggac

SEQ ID NO: 848683 - DNA, 20 bp, mouse
gtcgtcgcgtggctaggaac

SEQ ID NO: 848684 - DNA, 20 bp, mouse
gcctgtgggaagcggagtga

SEQ ID NO: 848685 - DNA, 20 bp, mouse
gagagaactacaactcccgt

SEQ ID NO: 848686 - DNA, 20 bp, mouse
ggacgcccaagaggtaccgg

SEQ ID NO: 848687 - DNA, 20 bp, mouse
ggtgctggccggaccgttgt

SEQ ID NO: 848688 - DNA, 20 bp, mouse
gggtaccggtggctgaactt

SEQ ID NO: 848689 - DNA, 20 bp, mouse
gctaagaagcgagaagcatg

SEQ ID NO: 848690 - DNA, 20 bp, mouse
ggcgccggggcgtcaaccga

SEQ ID NO: 848691 - DNA, 20 bp, mouse
gggcccaagtagctagccag

SEQ ID NO: 848692 - DNA, 20 bp, mouse
gtcagccaccggtacctctt

SEQ ID NO: 848693 - DNA, 20 bp, mouse
gggcagagaccatctccgat

SEQ ID NO: 848694 - DNA, 20 bp, mouse
gccgccggtaagtgaggagg

SEQ ID NO: 848695 - DNA, 20 bp, mouse
gaggaatgaacgggaagaac

SEQ ID NO: 848696 - DNA, 20 bp, mouse
gcgcaggtgcgccttggaat

SEQ ID NO: 848697 - DNA, 20 bp, mouse
ggggaaaacactaaagccta

SEQ ID NO: 848698 - DNA, 20 bp, mouse
gggcccggaatgacgtctgc

SEQ ID NO: 848699 - DNA, 20 bp, mouse
gcgcccgcagacgtcattcc

SEQ ID NO: 848700 - DNA, 20 bp, mouse
ggcacctgcgctgcaaactt

SEQ ID NO: 848701 - DNA, 20 bp, mouse
gttgcagcgcaggtgcgcct

SEQ ID NO: 848702 - DNA, 20 bp, mouse
gggtctccaaggaaatccga

SEQ ID NO: 848703 - DNA, 20 bp, mouse
gctcaaggaagctggcacaa

SEQ ID NO: 848704 - DNA, 20 bp, mouse
gtacgcatgcgcctgtcctc

SEQ ID NO: 848705 - DNA, 20 bp, mouse
gctgcaaacttaggaaacat

SEQ ID NO: 848706 - DNA, 20 bp, mouse
ggccccgcacaaaaagggag

SEQ ID NO: 848707 - DNA, 20 bp, mouse
gaaatggccccgcacaaaaa

SEQ ID NO: 848708 - DNA, 20 bp, mouse
ggggccctcctccatttgcg

SEQ ID NO: 848709 - DNA, 20 bp, mouse
gaggagaacaggccctctgg

SEQ ID NO: 848710 - DNA, 20 bp, mouse
gtggcctggggttgaatcta

SEQ ID NO: 848711 - DNA, 20 bp, mouse
gtcagtgtccgactagagca

SEQ ID NO: 848712 - DNA, 20 bp, mouse
gtaagcctgtcagaaggaaa

SEQ ID NO: 848713 - DNA, 20 bp, mouse
gagggcctgttctcctctct

SEQ ID NO: 848714 - DNA, 20 bp, mouse
gctgtcctagagaggagaac

SEQ ID NO: 848715 - DNA, 20 bp, mouse
gtcctctctaggacaggcat

SEQ ID NO: 848716 - DNA, 20 bp, mouse
gtgcccacggacgggtaagt

SEQ ID NO: 848717 - DNA, 20 bp, mouse
ggtgctgggctcgggaatga

SEQ ID NO: 848718 - DNA, 20 bp, mouse
ggacccgtccggtgcagctc

SEQ ID NO: 848719 - DNA, 20 bp, mouse
gggcgcttccccctgtcctg

SEQ ID NO: 848720 - DNA, 20 bp, mouse
gtggcctcacgacctttccc

SEQ ID NO: 848721 - DNA, 20 bp, mouse
gccccggagctgcaccggac

SEQ ID NO: 848722 - DNA, 20 bp, mouse
ggggccggagagaacggtgc

SEQ ID NO: 848723 - DNA, 20 bp, mouse
ggctgcaccggacgggtccc

SEQ ID NO: 848724 - DNA, 20 bp, mouse
gcacccacttacccgtccgt

SEQ ID NO: 848725 - DNA, 20 bp, mouse
gggacccgcgcctgcagcag

SEQ ID NO: 848726 - DNA, 20 bp, mouse
gtcgctcgggtggagttccc

SEQ ID NO: 848727 - DNA, 20 bp, mouse
gccgcaatcggagtaaacag

SEQ ID NO: 848728 - DNA, 20 bp, mouse
gacgcaaaagacgtattcaa

SEQ ID NO: 848729 - DNA, 20 bp, mouse
ggagcccccagctatcccat

SEQ ID NO: 848730 - DNA, 20 bp, mouse
gcggggaaatcgcgtaatgg

SEQ ID NO: 848731 - DNA, 20 bp, mouse
gagaccaatgggatagctgg

SEQ ID NO: 848732 - DNA, 20 bp, mouse
ggactcaggccggtggagtg

SEQ ID NO: 848733 - DNA, 20 bp, mouse
ggggaccgaaagtcgggtgg

SEQ ID NO: 848734 - DNA, 20 bp, mouse
ggcccccagccgcactccac

SEQ ID NO: 848735 - DNA, 20 bp, mouse
gtattcaaaggtagtgtccc

SEQ ID NO: 848736 - DNA, 20 bp, mouse
gctacaggtggggatccgag

SEQ ID NO: 848737 - DNA, 20 bp, mouse
gaggcctcctcctccaaggt

SEQ ID NO: 848738 - DNA, 20 bp, mouse
gtgtccgaggacatacaggt

SEQ ID NO: 848739 - DNA, 20 bp, mouse
gcggggcgttgcggagaagg

SEQ ID NO: 848740 - DNA, 20 bp, mouse
gcaacgggagagggcagcgt

SEQ ID NO: 848741 - DNA, 20 bp, mouse
ggggcggggcgttgcggaga

SEQ ID NO: 848742 - DNA, 20 bp, mouse
ggaagggtaagctacaggtg

SEQ ID NO: 848743 - DNA, 20 bp, mouse
gcaggtgaagggtaagctac

SEQ ID NO: 848744 - DNA, 20 bp, mouse
gtccaaggtgggtaaccaag

SEQ ID NO: 848745 - DNA, 20 bp, mouse
ggccccttggttacccacct

SEQ ID NO: 848746 - DNA, 20 bp, mouse
gatagtgcatatgtagtgtg

SEQ ID NO: 848747 - DNA, 20 bp, mouse
gagcccggagagccggaagt

SEQ ID NO: 848748 - DNA, 20 bp, mouse
gaggttaagcacagagtgtg

SEQ ID NO: 848749 - DNA, 20 bp, mouse
ggggcggggacgctcacgtg

SEQ ID NO: 848750 - DNA, 20 bp, mouse
gtctccgacttccggctctc

SEQ ID NO: 848751 - DNA, 20 bp, mouse
gtggggcggcttcctggtct

SEQ ID NO: 848752 - DNA, 20 bp, mouse
gagctcggctctccgacttc

SEQ ID NO: 848753 - DNA, 20 bp, mouse
gtgggagtgcgggtcaccgg

SEQ ID NO: 848754 - DNA, 20 bp, mouse
gagagtgtggggcggcttcc

SEQ ID NO: 848755 - DNA, 20 bp, mouse
gtccgggctgctggtgggcg

SEQ ID NO: 848756 - DNA, 20 bp, mouse
gcgcgcgcggtggtcattgg

SEQ ID NO: 848757 - DNA, 20 bp, mouse
gaaggtgggcgctgctgcaa

SEQ ID NO: 848758 - DNA, 20 bp, mouse
gcggacccgacgctccgcaa

SEQ ID NO: 848759 - DNA, 20 bp, mouse
ggcaaggctcatcccggttg

SEQ ID NO: 848760 - DNA, 20 bp, mouse
gcgtgcgcagactcagagcg

SEQ ID NO: 848761 - DNA, 20 bp, mouse
gagccttgccgcttccggaa

SEQ ID NO: 848762 - DNA, 20 bp, mouse
ggaagcggcaaggctcatcc

SEQ ID NO: 848763 - DNA, 20 bp, mouse
gcggcacgcagcaaccgagg

SEQ ID NO: 848764 - DNA, 20 bp, mouse
gccccggcacgcagcaaccg

SEQ ID NO: 848765 - DNA, 20 bp, mouse
ggcagcagcgcccacctttg

SEQ ID NO: 848766 - DNA, 20 bp, mouse
gccggggagagcacctccag

SEQ ID NO: 848767 - DNA, 20 bp, mouse
ggtgctgaacggccgttcat

SEQ ID NO: 848768 - DNA, 20 bp, mouse
gggagcaggcataacgacgc

SEQ ID NO: 848769 - DNA, 20 bp, mouse
gagcggcacaggcgccgctg

SEQ ID NO: 848770 - DNA, 20 bp, mouse
ggacagcaggaatgtggcgt

SEQ ID NO: 848771 - DNA, 20 bp, mouse
gccgctgcggattgggcaaa

SEQ ID NO: 848772 - DNA, 20 bp, mouse
gccctcccagccgtagctgc

SEQ ID NO: 848773 - DNA, 20 bp, mouse
gtcaacctgcagctacggct

SEQ ID NO: 848774 - DNA, 20 bp, mouse
gacaggcgccgctgcggatt

SEQ ID NO: 848775 - DNA, 20 bp, mouse
ggcgtgggagaggtcttagg

SEQ ID NO: 848776 - DNA, 20 bp, mouse
gtatccgattggataactat

SEQ ID NO: 848777 - DNA, 20 bp, mouse
gtggaatgaggcgggtctct

SEQ ID NO: 848778 - DNA, 20 bp, mouse
gtggcaacgcggtgagatcg

SEQ ID NO: 848779 - DNA, 20 bp, mouse
gacaactaacacagatccaa

SEQ ID NO: 848780 - DNA, 20 bp, mouse
gtggcctatagttatccaat

SEQ ID NO: 848781 - DNA, 20 bp, mouse
gtcaccgcgttgccaggcac

SEQ ID NO: 848782 - DNA, 20 bp, mouse
gtctacaatactctggaatg

SEQ ID NO: 848783 - DNA, 20 bp, mouse
gaacaggaagtgacgtgagc

SEQ ID NO: 848784 - DNA, 20 bp, mouse
gaaggaagctgctatttgat

SEQ ID NO: 848785 - DNA, 20 bp, mouse
ggtgtcaatctacaatactc

SEQ ID NO: 848786 - DNA, 20 bp, mouse
gcccccttggcagacagctt

SEQ ID NO: 848787 - DNA, 20 bp, mouse
gcagcccaagctgtctgcca

SEQ ID NO: 848788 - DNA, 20 bp, mouse
gatatgtcacgagaaggtgg

SEQ ID NO: 848789 - DNA, 20 bp, mouse
gccagcaccagcctagagcg

SEQ ID NO: 848790 - DNA, 20 bp, mouse
gagcaggccccgctctaggc

SEQ ID NO: 848791 - DNA, 20 bp, mouse
gctggcctgcaaatcaagtc

SEQ ID NO: 848792 - DNA, 20 bp, mouse
gccaggaccgggtcagagca

SEQ ID NO: 848793 - DNA, 20 bp, mouse
gggggaaatgacatcagttc

SEQ ID NO: 848794 - DNA, 20 bp, mouse
gagcgagcaggccccgctct

SEQ ID NO: 848795 - DNA, 20 bp, mouse
gtaggctggtgctggcatca

SEQ ID NO: 848796 - DNA, 20 bp, mouse
gtgcgcgcaggaactatgat

SEQ ID NO: 848797 - DNA, 20 bp, mouse
gtaaacgcagggcgaggccg

SEQ ID NO: 848798 - DNA, 20 bp, mouse
gctgatctggactgtcacgt

SEQ ID NO: 848799 - DNA, 20 bp, mouse
gtgtgatgcaggtgcaactt

SEQ ID NO: 848800 - DNA, 20 bp, mouse
ggctgaccaaccacctgatc

SEQ ID NO: 848801 - DNA, 20 bp, mouse
gagggcgaggccgcggttgc

SEQ ID NO: 848802 - DNA, 20 bp, mouse
gcgaacgacgccactagagg

SEQ ID NO: 848803 - DNA, 20 bp, mouse
gacagtccagatcaggtggt

SEQ ID NO: 848804 - DNA, 20 bp, mouse
gggcagtggtccggcaaccg

SEQ ID NO: 848805 - DNA, 20 bp, mouse
gttcccagcaggcagtggtc

SEQ ID NO: 848806 - DNA, 20 bp, mouse
gagagcctgggtgaggaaaa

SEQ ID NO: 848807 - DNA, 20 bp, mouse
gaggagctgtcacaagtcag

SEQ ID NO: 848808 - DNA, 20 bp, mouse
gacggggagggtctgaagga

SEQ ID NO: 848809 - DNA, 20 bp, mouse
gagtcagaggaggagagcct

SEQ ID NO: 848810 - DNA, 20 bp, mouse
gaggaaaaggggcgtgttcg

SEQ ID NO: 848811 - DNA, 20 bp, mouse
gtttacccctagaacgggga

SEQ ID NO: 848812 - DNA, 20 bp, mouse
gtgtaggcctaacatgacag

SEQ ID NO: 848813 - DNA, 20 bp, mouse
gagtgggcagctgtcacaag

SEQ ID NO: 848814 - DNA, 20 bp, mouse
gagctgtcacaagtcagagg

SEQ ID NO: 848815 - DNA, 20 bp, mouse
gtgggcgggtccctgaggag

SEQ ID NO: 848816 - DNA, 20 bp, mouse
gaggtggggtcggtataaag

SEQ ID NO: 848817 - DNA, 20 bp, mouse
gggccccgagcgtccgaccc

SEQ ID NO: 848818 - DNA, 20 bp, mouse
gtataccgaccccacctctc

SEQ ID NO: 848819 - DNA, 20 bp, mouse
gcgagcgcctggaaaagtac

SEQ ID NO: 848820 - DNA, 20 bp, mouse
ggccgcgagtaccgccccgt

SEQ ID NO: 848821 - DNA, 20 bp, mouse
ggacgaaagcgcgacgggac

SEQ ID NO: 848822 - DNA, 20 bp, mouse
gcgacccaggctccatcccg

SEQ ID NO: 848823 - DNA, 20 bp, mouse
gaggaccgcgggatggagcc

SEQ ID NO: 848824 - DNA, 20 bp, mouse
gagtaccgccccgtggggga

SEQ ID NO: 848825 - DNA, 20 bp, mouse
ggggaggcgatcgagcctct

SEQ ID NO: 848826 - DNA, 20 bp, mouse
ggggctaaggaaagctaggt

SEQ ID NO: 848827 - DNA, 20 bp, mouse
ggggtggtagatgggagcgg

SEQ ID NO: 848828 - DNA, 20 bp, mouse
gctaaggaaagctaggtggg

SEQ ID NO: 848829 - DNA, 20 bp, mouse
gtccactcccacaaaaagcg

SEQ ID NO: 848830 - DNA, 20 bp, mouse
gccaaatgaatgtttagaga

SEQ ID NO: 848831 - DNA, 20 bp, mouse
gatcggggaccggacctcac

SEQ ID NO: 848832 - DNA, 20 bp, mouse
ggtagatgggagcggagggc

SEQ ID NO: 848833 - DNA, 20 bp, mouse
gcctccagaaaagactgaca

SEQ ID NO: 848834 - DNA, 20 bp, mouse
ggcagttaggagcgtgagac

SEQ ID NO: 848835 - DNA, 20 bp, mouse
ggagatctacgtcaccagtg

SEQ ID NO: 848836 - DNA, 20 bp, mouse
gcaaagacttgagaaggcta

SEQ ID NO: 848837 - DNA, 20 bp, mouse
gggctgaaggcgacgcgcta

SEQ ID NO: 848838 - DNA, 20 bp, mouse
gggcagatgattactactcc

SEQ ID NO: 848839 - DNA, 20 bp, mouse
gtccgccaggctagaggtca

SEQ ID NO: 848840 - DNA, 20 bp, mouse
gcaagggtgacacaagatgg

SEQ ID NO: 848841 - DNA, 20 bp, mouse
gtcccctactcatggataga

SEQ ID NO: 848842 - DNA, 20 bp, mouse
gagcctggcggaagtagata

SEQ ID NO: 848843 - DNA, 20 bp, mouse
gtataccctaaggatgtgtg

SEQ ID NO: 848844 - DNA, 20 bp, mouse
gagatggcggcgcccataag

SEQ ID NO: 848845 - DNA, 20 bp, mouse
gatacggccatgcttactac

SEQ ID NO: 848846 - DNA, 20 bp, mouse
gaggccccggaggctcgtgt

SEQ ID NO: 848847 - DNA, 20 bp, mouse
gcggggcctgccggacacac

SEQ ID NO: 848848 - DNA, 20 bp, mouse
gggacacactggcttgtctc

SEQ ID NO: 848849 - DNA, 20 bp, mouse
gtagggacttggaacgtgtc

SEQ ID NO: 848850 - DNA, 20 bp, mouse
ggctgcggagcgcacagcta

SEQ ID NO: 848851 - DNA, 20 bp, mouse
ggtccctacacgagcctccg

SEQ ID NO: 848852 - DNA, 20 bp, mouse
gcacactggcttgtctcggg

SEQ ID NO: 848853 - DNA, 20 bp, mouse
gcccccgcagcctgtcacca

SEQ ID NO: 848854 - DNA, 20 bp, mouse
gggtgaccaagggaccgcga

SEQ ID NO: 848855 - DNA, 20 bp, mouse
gaatggctagagggaaaatc

SEQ ID NO: 848856 - DNA, 20 bp, mouse
ggcgccgaggcagccaatgg

SEQ ID NO: 848857 - DNA, 20 bp, mouse
ggagatggtggcaggtccgg

SEQ ID NO: 848858 - DNA, 20 bp, mouse
gcaggattcgaggcctccat

SEQ ID NO: 848859 - DNA, 20 bp, mouse
gccccctcccagccacaaca

SEQ ID NO: 848860 - DNA, 20 bp, mouse
ggtggaccctgtcaccgcta

SEQ ID NO: 848861 - DNA, 20 bp, mouse
gggaggcctcgaatcctgag

SEQ ID NO: 848862 - DNA, 20 bp, mouse
ggaaggtggggacgccgctc

SEQ ID NO: 848863 - DNA, 20 bp, mouse
gcgccatgttgtggctggga

SEQ ID NO: 848864 - DNA, 20 bp, mouse
gggacgccgctcaggattcg

SEQ ID NO: 848865 - DNA, 20 bp, mouse
gggaactcggaggcaacccc

SEQ ID NO: 848866 - DNA, 20 bp, mouse
gcagacccgagggaagtgga

SEQ ID NO: 848867 - DNA, 20 bp, mouse
ggcgagggaggaagcgaggc

SEQ ID NO: 848868 - DNA, 20 bp, mouse
gacgctcattggctcaggga

SEQ ID NO: 848869 - DNA, 20 bp, mouse
ggcaatacgctcattggctc

SEQ ID NO: 848870 - DNA, 20 bp, mouse
gtctcacgcaatacgctcat

SEQ ID NO: 848871 - DNA, 20 bp, mouse
gaagatctcaaactcacgtg

SEQ ID NO: 848872 - DNA, 20 bp, mouse
gacgcccctccacttccctc

SEQ ID NO: 848873 - DNA, 20 bp, mouse
gctccagcaccgcgacgatt

SEQ ID NO: 848874 - DNA, 20 bp, mouse
gcttctccaggcagacccga

SEQ ID NO: 848875 - DNA, 20 bp, mouse
gcaggcagacccgagggaag

SEQ ID NO: 848876 - DNA, 20 bp, mouse
ggagccagacttgacctcag

SEQ ID NO: 848877 - DNA, 20 bp, mouse
gactcaacccccacatctgg

SEQ ID NO: 848878 - DNA, 20 bp, mouse
gaactaggcgattctgaaat

SEQ ID NO: 848879 - DNA, 20 bp, mouse
ggtaaagggagctatggcaa

SEQ ID NO: 848880 - DNA, 20 bp, mouse
gctacccttgcggtccaact

SEQ ID NO: 848881 - DNA, 20 bp, mouse
ggctcctctgaggtcaagtc

SEQ ID NO: 848882 - DNA, 20 bp, mouse
gggggggcggtgaggacaga

SEQ ID NO: 848883 - DNA, 20 bp, mouse
gcaaagggtagtgtgtcatg

SEQ ID NO: 848884 - DNA, 20 bp, mouse
gaggtagacaattgatccta

SEQ ID NO: 848885 - DNA, 20 bp, mouse
gctgccttgcaccacgccag

SEQ ID NO: 848886 - DNA, 20 bp, mouse
gagtgctcgcgagcttacgg

SEQ ID NO: 848887 - DNA, 20 bp, mouse
gcggtgcgatactgtttgag

SEQ ID NO: 848888 - DNA, 20 bp, mouse
ggggacgcgccggttgctta

SEQ ID NO: 848889 - DNA, 20 bp, mouse
gcggcggcgtggagcacacg

SEQ ID NO: 848890 - DNA, 20 bp, mouse
gcaagtactacgggaatctg

SEQ ID NO: 848891 - DNA, 20 bp, mouse
gcggcttcaccaagtactac

SEQ ID NO: 848892 - DNA, 20 bp, mouse
ggtaccagtcgcagctccca

SEQ ID NO: 848893 - DNA, 20 bp, mouse
gcggcccatcagctgaccgc

SEQ ID NO: 848894 - DNA, 20 bp, mouse
gccgcccggcggtcagctga

SEQ ID NO: 848895 - DNA, 20 bp, mouse
gtcacagaattataactgtg

SEQ ID NO: 848896 - DNA, 20 bp, mouse
gcaaagctttgggtgtggaa

SEQ ID NO: 848897 - DNA, 20 bp, mouse
gcccagagtctggagagggt

SEQ ID NO: 848898 - DNA, 20 bp, mouse
ggcggggcggaagtggctcc

SEQ ID NO: 848899 - DNA, 20 bp, mouse
ggcgggcctcggttacttac

SEQ ID NO: 848900 - DNA, 20 bp, mouse
gaaggcggccaacccacttc

SEQ ID NO: 848901 - DNA, 20 bp, mouse
gaatgcgcgtgcgtcagtcc

SEQ ID NO: 848902 - DNA, 20 bp, mouse
gcgaggcccgcagtgctgtc

SEQ ID NO: 848903 - DNA, 20 bp, mouse
gggcaagagccgtttctcta

SEQ ID NO: 848904 - DNA, 20 bp, mouse
ggctgctagtgcccatcctc

SEQ ID NO: 848905 - DNA, 20 bp, mouse
gggcctcggttacttacggg

SEQ ID NO: 848906 - DNA, 20 bp, mouse
gtggttcatagggttgttct

SEQ ID NO: 848907 - DNA, 20 bp, mouse
gtaaagaagcggcagattgt

SEQ ID NO: 848908 - DNA, 20 bp, mouse
ggggaaccagtatggagttg

SEQ ID NO: 848909 - DNA, 20 bp, mouse
gttgaggttgcgtggttcat

SEQ ID NO: 848910 - DNA, 20 bp, mouse
gtctttagacgcagagaggc

SEQ ID NO: 848911 - DNA, 20 bp, mouse
ggctggcttagtcgaggcaa

SEQ ID NO: 848912 - DNA, 20 bp, mouse
gctctctgcgtctaaagaag

SEQ ID NO: 848913 - DNA, 20 bp, mouse
gcagattgttggcccgtcat

SEQ ID NO: 848914 - DNA, 20 bp, mouse
gacttttgtgggaaccagta

SEQ ID NO: 848915 - DNA, 20 bp, mouse
gatccccttaggattcgcac

SEQ ID NO: 848916 - DNA, 20 bp, mouse
gcagcaggctggggtccgta

SEQ ID NO: 848917 - DNA, 20 bp, mouse
ggtgggacctaggaacagaa

SEQ ID NO: 848918 - DNA, 20 bp, mouse
ggctccttggagggaaggat

SEQ ID NO: 848919 - DNA, 20 bp, mouse
gcagaggcggaattcagaca

SEQ ID NO: 848920 - DNA, 20 bp, mouse
gtcaccaaacacacagtctc

SEQ ID NO: 848921 - DNA, 20 bp, mouse
gtcccctgagactgtgtgtt

SEQ ID NO: 848922 - DNA, 20 bp, mouse
ggcaacaaacagcccccacc

SEQ ID NO: 848923 - DNA, 20 bp, mouse
ggaggctgagggttaggacg

SEQ ID NO: 848924 - DNA, 20 bp, mouse
ggggtggtggtcaaagcctg

SEQ ID NO: 848925 - DNA, 20 bp, mouse
gggtgtgtggaataccaata

SEQ ID NO: 848926 - DNA, 20 bp, mouse
gtgggagccgaacccggaag

SEQ ID NO: 848927 - DNA, 20 bp, mouse
ggtccctggagagcaggcgg

SEQ ID NO: 848928 - DNA, 20 bp, mouse
gaaaaggtgggagccgaacc

SEQ ID NO: 848929 - DNA, 20 bp, mouse
ggaccgtggagccggggcgg

SEQ ID NO: 848930 - DNA, 20 bp, mouse
gcctcgaagccgagagctgg

SEQ ID NO: 848931 - DNA, 20 bp, mouse
gccgcctcgaagccgagagc

SEQ ID NO: 848932 - DNA, 20 bp, mouse
gcggaagtggcggcggtccc

SEQ ID NO: 848933 - DNA, 20 bp, mouse
gccgctctgaaagaaaaggt

SEQ ID NO: 848934 - DNA, 20 bp, mouse
gagcgagcgccgggtgatgg

SEQ ID NO: 848935 - DNA, 20 bp, mouse
gccgccgccacttccgggtt

SEQ ID NO: 848936 - DNA, 20 bp, mouse
gagaggaggcgttaactcga

SEQ ID NO: 848937 - DNA, 20 bp, mouse
gggagcgcgtctgtgagcag

SEQ ID NO: 848938 - DNA, 20 bp, mouse
gtcgctgcaaagtagtcccg

SEQ ID NO: 848939 - DNA, 20 bp, mouse
ggggctggcccgcaaaggtt

SEQ ID NO: 848940 - DNA, 20 bp, mouse
gggggaggatagattctcgg

SEQ ID NO: 848941 - DNA, 20 bp, mouse
gccccaagactaaacaaggg

SEQ ID NO: 848942 - DNA, 20 bp, mouse
ggacgtgtgctgtcgctcag

SEQ ID NO: 848943 - DNA, 20 bp, mouse
ggccgcccttgtttagtctt

SEQ ID NO: 848944 - DNA, 20 bp, mouse
gcctcccccaagactaaaca

SEQ ID NO: 848945 - DNA, 20 bp, mouse
ggagtgaggcgcctgcctga

SEQ ID NO: 848946 - DNA, 20 bp, mouse
gcggaagcgcggccccggcg

SEQ ID NO: 848947 - DNA, 20 bp, mouse
gggtgtccgcgcaggctcgt

SEQ ID NO: 848948 - DNA, 20 bp, mouse
ggacgcgacccgtgaaaagg

SEQ ID NO: 848949 - DNA, 20 bp, mouse
ggccccgcgcgctaccgctg

SEQ ID NO: 848950 - DNA, 20 bp, mouse
gcgggagggttttttttctt

SEQ ID NO: 848951 - DNA, 20 bp, mouse
gacaacccaacccggaagcg

SEQ ID NO: 848952 - DNA, 20 bp, mouse
ggacccgtgaaaaggcggcg

SEQ ID NO: 848953 - DNA, 20 bp, mouse
gccggggcgggcccgcaagc

SEQ ID NO: 848954 - DNA, 20 bp, mouse
ggcgcggagggttgtaggtg

SEQ ID NO: 848955 - DNA, 20 bp, mouse
ggagggttgtaggtgcgggg

SEQ ID NO: 848956 - DNA, 20 bp, mouse
gaatcccatggagtgtgggt

SEQ ID NO: 848957 - DNA, 20 bp, mouse
gaagtgaatcccatggagtg

SEQ ID NO: 848958 - DNA, 20 bp, mouse
gagctccaacccacactcca

SEQ ID NO: 848959 - DNA, 20 bp, mouse
ggacgcgactacccggactt

SEQ ID NO: 848960 - DNA, 20 bp, mouse
gacgacggactattggaagg

SEQ ID NO: 848961 - DNA, 20 bp, mouse
gggaagaaagcagatgcgac

SEQ ID NO: 848962 - DNA, 20 bp, mouse
gcgcgtccgcgccagcagtt

SEQ ID NO: 848963 - DNA, 20 bp, mouse
gggcccttcttcctaaagta

SEQ ID NO: 848964 - DNA, 20 bp, mouse
ggaagcgcccaggttggggt

SEQ ID NO: 848965 - DNA, 20 bp, mouse
gctagttcctggagagacga

SEQ ID NO: 848966 - DNA, 20 bp, mouse
gtgaaacgcgctcccttctg

SEQ ID NO: 848967 - DNA, 20 bp, mouse
ggaagggaactgggcgacgg

SEQ ID NO: 848968 - DNA, 20 bp, mouse
gtacaactcccagtgttcag

SEQ ID NO: 848969 - DNA, 20 bp, mouse
gaaaggagaacgagtcggaa

SEQ ID NO: 848970 - DNA, 20 bp, mouse
gtcggaagggaactgggcga

SEQ ID NO: 848971 - DNA, 20 bp, mouse
gtcgggaaaggagaacgagt

SEQ ID NO: 848972 - DNA, 20 bp, mouse
gcggcctcggagccaagacg

SEQ ID NO: 848973 - DNA, 20 bp, mouse
gggcttcagagcggaaactc

SEQ ID NO: 848974 - DNA, 20 bp, mouse
gcagagcggaaactcgggaa

SEQ ID NO: 848975 - DNA, 20 bp, mouse
gaaggggactggatgctttt

SEQ ID NO: 848976 - DNA, 20 bp, mouse
gttgcctggagcttgagaca

SEQ ID NO: 848977 - DNA, 20 bp, mouse
gggagcctcggtccttgtat

SEQ ID NO: 848978 - DNA, 20 bp, mouse
gagcctcgcaggcgcattaa

SEQ ID NO: 848979 - DNA, 20 bp, mouse
gaactcaaggggtggagcct

SEQ ID NO: 848980 - DNA, 20 bp, mouse
gggggcgcctcaagagctag

SEQ ID NO: 848981 - DNA, 20 bp, mouse
ggagcacagagcaaatcgat

SEQ ID NO: 848982 - DNA, 20 bp, mouse
gggagggcagaaggcttgat

SEQ ID NO: 848983 - DNA, 20 bp, mouse
gggaacctttcccggggcgt

SEQ ID NO: 848984 - DNA, 20 bp, mouse
gataatgtactgtgatcaga

SEQ ID NO: 848985 - DNA, 20 bp, mouse
ggggcagaaggcttgatggg

SEQ ID NO: 848986 - DNA, 20 bp, mouse
gaactcaaacacagtgggct

SEQ ID NO: 848987 - DNA, 20 bp, mouse
gacagacctgtacacgggag

SEQ ID NO: 848988 - DNA, 20 bp, mouse
gaagtcacagacctgtacac

SEQ ID NO: 848989 - DNA, 20 bp, mouse
gttcctcctctcccgtgtac

SEQ ID NO: 848990 - DNA, 20 bp, mouse
gcctcccaacatttgcaaga

SEQ ID NO: 848991 - DNA, 20 bp, mouse
gttctggaaatgtaggtggt

SEQ ID NO: 848992 - DNA, 20 bp, mouse
gaaatcaactcaaacacagt

SEQ ID NO: 848993 - DNA, 20 bp, mouse
gatggataaaatacatacta

SEQ ID NO: 848994 - DNA, 20 bp, mouse
gttcccctcttgcaaatgtt

SEQ ID NO: 848995 - DNA, 20 bp, mouse
gatgcgtgctaggttcatgc

SEQ ID NO: 848996 - DNA, 20 bp, mouse
ggtcacgtgcaattctgggg

SEQ ID NO: 848997 - DNA, 20 bp, mouse
gacagggaggcggaagtccc

SEQ ID NO: 848998 - DNA, 20 bp, mouse
ggaaacagggcccggagagt

SEQ ID NO: 848999 - DNA, 20 bp, mouse
gccgcccctgagagctgagt

SEQ ID NO: 849000 - DNA, 20 bp, mouse
ggtgctccaatcagatacta

SEQ ID NO: 849001 - DNA, 20 bp, mouse
gggtgggcggaacccgactc

SEQ ID NO: 849002 - DNA, 20 bp, mouse
gaagcaccctagtatctgat

SEQ ID NO: 849003 - DNA, 20 bp, mouse
gtctccgggccctgtttcca

SEQ ID NO: 849004 - DNA, 20 bp, mouse
gctgcactgtgaagggtggg

SEQ ID NO: 849005 - DNA, 20 bp, mouse
gtgattggagcacatgggac

SEQ ID NO: 849006 - DNA, 20 bp, mouse
gaggcaatcaacagcctcct

SEQ ID NO: 849007 - DNA, 20 bp, mouse
gtaaaaagttcgcggctctg

SEQ ID NO: 849008 - DNA, 20 bp, mouse
gcgcatgcgtaaaaagttcg

SEQ ID NO: 849009 - DNA, 20 bp, mouse
gtacgcatgtgcaggtcgtc

SEQ ID NO: 849010 - DNA, 20 bp, mouse
gtttacgcatgcgcacgtta

SEQ ID NO: 849011 - DNA, 20 bp, mouse
gctggggcggagctagcagc

SEQ ID NO: 849012 - DNA, 20 bp, mouse
ggcgctatggccgttctagt

SEQ ID NO: 849013 - DNA, 20 bp, mouse
gacaccaggagcttcttcgg

SEQ ID NO: 849014 - DNA, 20 bp, mouse
gccgcccccgaagaagctcc

SEQ ID NO: 849015 - DNA, 20 bp, mouse
gtagcttcaccaagccgagg

SEQ ID NO: 849016 - DNA, 20 bp, mouse
ggggaagttgaatgctacga

SEQ ID NO: 849017 - DNA, 20 bp, mouse
ggggtagagtcacgtgatgg

SEQ ID NO: 849018 - DNA, 20 bp, mouse
gggtgggtagagtcacgtga

SEQ ID NO: 849019 - DNA, 20 bp, mouse
gcctgagctctgattgggtg

SEQ ID NO: 849020 - DNA, 20 bp, mouse
gggcctaggagcggttgtaa

SEQ ID NO: 849021 - DNA, 20 bp, mouse
ggacccagaggttggcaagt

SEQ ID NO: 849022 - DNA, 20 bp, mouse
gttcctgcctgagctctgat

SEQ ID NO: 849023 - DNA, 20 bp, mouse
gccgccccacgctcgctgat

SEQ ID NO: 849024 - DNA, 20 bp, mouse
gttagctagtgtgatcgggg

SEQ ID NO: 849025 - DNA, 20 bp, mouse
ggaacgcggtagcggggcgg

SEQ ID NO: 849026 - DNA, 20 bp, mouse
gtcgacccgcaccaggaggg

SEQ ID NO: 849027 - DNA, 20 bp, mouse
gctggcgcgctccacccgga

SEQ ID NO: 849028 - DNA, 20 bp, mouse
gccaggagggcggcacccag

SEQ ID NO: 849029 - DNA, 20 bp, mouse
gagccagcccccacgaaggc

SEQ ID NO: 849030 - DNA, 20 bp, mouse
gaaggcgggccgaagcgaag

SEQ ID NO: 849031 - DNA, 20 bp, mouse
gcgaagctgcagagcgagac

SEQ ID NO: 849032 - DNA, 20 bp, mouse
gagcttgcgcacgcccctcc

SEQ ID NO: 849033 - DNA, 20 bp, mouse
gggcgagccagcccccacga

SEQ ID NO: 849034 - DNA, 20 bp, mouse
gggtgccgccctcctggtgc

SEQ ID NO: 849035 - DNA, 20 bp, mouse
gaagctagggaggactccga

SEQ ID NO: 849036 - DNA, 20 bp, mouse
gctaacgcctacagaggcag

SEQ ID NO: 849037 - DNA, 20 bp, mouse
gactcagaggatgtcctccc

SEQ ID NO: 849038 - DNA, 20 bp, mouse
gaggcgttagggcacacgtg

SEQ ID NO: 849039 - DNA, 20 bp, mouse
gaaaaccagaaataccaggg

SEQ ID NO: 849040 - DNA, 20 bp, mouse
gtgttggtccacattaagtc

SEQ ID NO: 849041 - DNA, 20 bp, mouse
gtgtgccctaacgcctacag

SEQ ID NO: 849042 - DNA, 20 bp, mouse
ggtggagtcccgcatatggt

SEQ ID NO: 849043 - DNA, 20 bp, mouse
gcgtattagtgcttctgagt

SEQ ID NO: 849044 - DNA, 20 bp, mouse
gtagaacaggcaaaacatac

SEQ ID NO: 849045 - DNA, 20 bp, mouse
gaatacgatgtattgggagt

SEQ ID NO: 849046 - DNA, 20 bp, mouse
ggggctccctggttttaact

SEQ ID NO: 849047 - DNA, 20 bp, mouse
ggagcaaacggaccagaatt

SEQ ID NO: 849048 - DNA, 20 bp, mouse
gacgagttgtcactcacttc

SEQ ID NO: 849049 - DNA, 20 bp, mouse
gaaaccagggagcccaattc

SEQ ID NO: 849050 - DNA, 20 bp, mouse
gaaaataaacatagcctagt

SEQ ID NO: 849051 - DNA, 20 bp, mouse
ggaagcgctgttcgcagaca

SEQ ID NO: 849052 - DNA, 20 bp, mouse
gtggtagagaacttgtctct

SEQ ID NO: 849053 - DNA, 20 bp, mouse
gtataaccaagttaaaacca

SEQ ID NO: 849054 - DNA, 20 bp, mouse
gggaccagaattgggctccc

SEQ ID NO: 849055 - DNA, 20 bp, mouse
gactacttccggtaatgggc

SEQ ID NO: 849056 - DNA, 20 bp, mouse
ggacgcccaagaggtaccgg

SEQ ID NO: 849057 - DNA, 20 bp, mouse
gggtaccggtggctgaactt

SEQ ID NO: 849058 - DNA, 20 bp, mouse
gtcagccaccggtacctctt

SEQ ID NO: 849059 - DNA, 20 bp, mouse
ggcgccggggcgtcaaccga

SEQ ID NO: 849060 - DNA, 20 bp, mouse
gccgccggtaagtgaggagg

SEQ ID NO: 849061 - DNA, 20 bp, mouse
ggggccgccggtaagtgagg

SEQ ID NO: 849062 - DNA, 20 bp, mouse
gggtacctcttgggcgtccg

SEQ ID NO: 849063 - DNA, 20 bp, mouse
gcacccccaagttcagccac

SEQ ID NO: 849064 - DNA, 20 bp, mouse
gactgcgccgggagcgaggg

SEQ ID NO: 849065 - DNA, 20 bp, mouse
gttaccggcggcccccactt

SEQ ID NO: 849066 - DNA, 20 bp, mouse
gaggccgtggggtgaaggcg

SEQ ID NO: 849067 - DNA, 20 bp, mouse
ggggtgaggccgtggggtga

SEQ ID NO: 849068 - DNA, 20 bp, mouse
gcgcctgacccggggagcca

SEQ ID NO: 849069 - DNA, 20 bp, mouse
gcgtggggtgaaggcgaggg

SEQ ID NO: 849070 - DNA, 20 bp, mouse
gccgccggacacacacgtgc

SEQ ID NO: 849071 - DNA, 20 bp, mouse
gagccagggcggcctcgcac

SEQ ID NO: 849072 - DNA, 20 bp, mouse
gagcaggtatggaacctata

SEQ ID NO: 849073 - DNA, 20 bp, mouse
gcgcctgtgcgaggccgccc

SEQ ID NO: 849074 - DNA, 20 bp, mouse
ggcggccggggtgaggccgt

SEQ ID NO: 849075 - DNA, 20 bp, mouse
gtgaaggcgagggcggccgg

SEQ ID NO: 849076 - DNA, 20 bp, mouse
gtggaactcgccccagctgg

SEQ ID NO: 849077 - DNA, 20 bp, mouse
gcccccaggggcctgtccta

SEQ ID NO: 849078 - DNA, 20 bp, mouse
ggggcgtggcggtgagttcg

SEQ ID NO: 849079 - DNA, 20 bp, mouse
ggccccagctggcggaaaag

SEQ ID NO: 849080 - DNA, 20 bp, mouse
ggcccggaagtgtggtactc

SEQ ID NO: 849081 - DNA, 20 bp, mouse
ggtggcggtgagttcggggt

SEQ ID NO: 849082 - DNA, 20 bp, mouse
ggtaagagggaccttaggac

SEQ ID NO: 849083 - DNA, 20 bp, mouse
gcacgccagccgcgtcgcta

SEQ ID NO: 849084 - DNA, 20 bp, mouse
ggcctcttttccgccagctg

SEQ ID NO: 849085 - DNA, 20 bp, mouse
ggggaaccgacggtggggaa

SEQ ID NO: 849086 - DNA, 20 bp, mouse
gcccgagcgctgtgagagaa

SEQ ID NO: 849087 - DNA, 20 bp, mouse
gacggcagagcgctgtgatt

SEQ ID NO: 849088 - DNA, 20 bp, mouse
ggaagcgaaccggtctccag

SEQ ID NO: 849089 - DNA, 20 bp, mouse
gctctggcaagcaaagtgta

SEQ ID NO: 849090 - DNA, 20 bp, mouse
gaagggagggcgacacagtc

SEQ ID NO: 849091 - DNA, 20 bp, mouse
gcgctcgggcgggcccatcc

SEQ ID NO: 849092 - DNA, 20 bp, mouse
gggcggaggctgaagcgaac

SEQ ID NO: 849093 - DNA, 20 bp, mouse
gtcgctgtcgccagtcaccc

SEQ ID NO: 849094 - DNA, 20 bp, mouse
ggcgacacagtcgggtgcgg

SEQ ID NO: 849095 - DNA, 20 bp, mouse
ggcggcggctgggagggatt

SEQ ID NO: 849096 - DNA, 20 bp, mouse
gcgtgccggaagtccctcag

SEQ ID NO: 849097 - DNA, 20 bp, mouse
gacgtggaacctgggttccg

SEQ ID NO: 849098 - DNA, 20 bp, mouse
gtcggcccctgagggacttc

SEQ ID NO: 849099 - DNA, 20 bp, mouse
gtgaatattctatgcagggg

SEQ ID NO: 849100 - DNA, 20 bp, mouse
ggacgcccggagcgtttagg

SEQ ID NO: 849101 - DNA, 20 bp, mouse
gattaatcgcttactcgctg

SEQ ID NO: 849102 - DNA, 20 bp, mouse
gtctctcggctcggcccctg

SEQ ID NO: 849103 - DNA, 20 bp, mouse
gaaccaggcgcgcgtcgcta

SEQ ID NO: 849104 - DNA, 20 bp, mouse
gcgggcgtccacggcagccc

SEQ ID NO: 849105 - DNA, 20 bp, mouse
gcaggcgcgcgtcgctaggg

SEQ ID NO: 849106 - DNA, 20 bp, mouse
gtgcgcgcaggtgaggggtg

SEQ ID NO: 849107 - DNA, 20 bp, mouse
ggaggggtggggcttggata

SEQ ID NO: 849108 - DNA, 20 bp, mouse
gagagcatgcgcgcaggtga

SEQ ID NO: 849109 - DNA, 20 bp, mouse
gtgtgccgcaggtctaccgt

SEQ ID NO: 849110 - DNA, 20 bp, mouse
gaatatgcaggatgcctcat

SEQ ID NO: 849111 - DNA, 20 bp, mouse
gtcatggggtgaggaatgaa

SEQ ID NO: 849112 - DNA, 20 bp, mouse
gtcgaatagagcatgcgcgc

SEQ ID NO: 849113 - DNA, 20 bp, mouse
ggagccctacggtagacctg

SEQ ID NO: 849114 - DNA, 20 bp, mouse
ggtgaggaatgaaaggcgaa

SEQ ID NO: 849115 - DNA, 20 bp, mouse
gtgaggccgtgatgacgcac

SEQ ID NO: 849116 - DNA, 20 bp, mouse
gcgctgcggttttgttgtat

SEQ ID NO: 849117 - DNA, 20 bp, mouse
gcaaacggaagtccgacgag

SEQ ID NO: 849118 - DNA, 20 bp, mouse
ggctgtaaccagttcaaaaa

SEQ ID NO: 849119 - DNA, 20 bp, mouse
gccgctaaggtcacgttcca

SEQ ID NO: 849120 - DNA, 20 bp, mouse
gcgtggtataaggaaaagag

SEQ ID NO: 849121 - DNA, 20 bp, mouse
gaacagctcttcgtggtata

SEQ ID NO: 849122 - DNA, 20 bp, mouse
gccaaatggcctctgggcat

SEQ ID NO: 849123 - DNA, 20 bp, mouse
gaagagcggaagtgaggcgt

SEQ ID NO: 849124 - DNA, 20 bp, mouse
gcggaccagcatggcccact

SEQ ID NO: 849125 - DNA, 20 bp, mouse
gaaggaaaagagcggaagtg

SEQ ID NO: 849126 - DNA, 20 bp, mouse
gcggctgtgtaattggtgtg

SEQ ID NO: 849127 - DNA, 20 bp, mouse
gaagcgggcgggaacggggt

SEQ ID NO: 849128 - DNA, 20 bp, mouse
ggatggggcggctgtgtaat

SEQ ID NO: 849129 - DNA, 20 bp, mouse
ggcgctgggagagatacgca

SEQ ID NO: 849130 - DNA, 20 bp, mouse
gggggatgaagggacggcgc

SEQ ID NO: 849131 - DNA, 20 bp, mouse
gacacagcggcggggatgaa

SEQ ID NO: 849132 - DNA, 20 bp, mouse
gggggcgcttagagaacttc

SEQ ID NO: 849133 - DNA, 20 bp, mouse
gaatggaggcggcgcgacgg

SEQ ID NO: 849134 - DNA, 20 bp, mouse
gcaccggcgggctacaggaa

SEQ ID NO: 849135 - DNA, 20 bp, mouse
ggtggcctcccgccccgtgt

SEQ ID NO: 849136 - DNA, 20 bp, mouse
ggatccggagccgatggtac

SEQ ID NO: 849137 - DNA, 20 bp, mouse
gaggactttaatgacttaag

SEQ ID NO: 849138 - DNA, 20 bp, mouse
gttgaagtgactcattttca

SEQ ID NO: 849139 - DNA, 20 bp, mouse
gctgcgggcgagtggaactt

SEQ ID NO: 849140 - DNA, 20 bp, mouse
gactcgcccgcaggctccga

SEQ ID NO: 849141 - DNA, 20 bp, mouse
gggaactttggttcctcaca

SEQ ID NO: 849142 - DNA, 20 bp, mouse
gagctcccctcggagcctgc

SEQ ID NO: 849143 - DNA, 20 bp, mouse
gagtgcggttggtttcctct

SEQ ID NO: 849144 - DNA, 20 bp, mouse
gcggtccgttcctgtaccat

SEQ ID NO: 849145 - DNA, 20 bp, mouse
ggctggtttctcagtgcggt

SEQ ID NO: 849146 - DNA, 20 bp, mouse
gagcctgtgggactgagcga

SEQ ID NO: 849147 - DNA, 20 bp, mouse
gagtgactgcagaacgagta

SEQ ID NO: 849148 - DNA, 20 bp, mouse
gatcccgcggaacaagcctg

SEQ ID NO: 849149 - DNA, 20 bp, mouse
gtcccacaggcttgttccgc

SEQ ID NO: 849150 - DNA, 20 bp, mouse
gctccttcgctcagtcccac

SEQ ID NO: 849151 - DNA, 20 bp, mouse
ggtcccctggtggcgcaagt

SEQ ID NO: 849152 - DNA, 20 bp, mouse
gaaaacaggagactatcccg

SEQ ID NO: 849153 - DNA, 20 bp, mouse
gcgctgctaggccatagttt

SEQ ID NO: 849154 - DNA, 20 bp, mouse
gggctgcggaagttctttcc

SEQ ID NO: 849155 - DNA, 20 bp, mouse
gggactgagcgaaggagacc

SEQ ID NO: 849156 - DNA, 20 bp, mouse
gtcgacagccagaggagctc

SEQ ID NO: 849157 - DNA, 20 bp, mouse
gtccatggaaggtggtagtg

SEQ ID NO: 849158 - DNA, 20 bp, mouse
gagcaggcaggttccaaggt

SEQ ID NO: 849159 - DNA, 20 bp, mouse
gcggggcggcgcagccgcag

SEQ ID NO: 849160 - DNA, 20 bp, mouse
gctaccaccttccatggagg

SEQ ID NO: 849161 - DNA, 20 bp, mouse
gcggggctggaagtacagga

SEQ ID NO: 849162 - DNA, 20 bp, mouse
gccgccccgccccattacca

SEQ ID NO: 849163 - DNA, 20 bp, mouse
gtgagaggaaggagtccttg

SEQ ID NO: 849164 - DNA, 20 bp, mouse
gtctgagccgcctccatgga

SEQ ID NO: 849165 - DNA, 20 bp, mouse
gacactgcgtcccggtgcgc

SEQ ID NO: 849166 - DNA, 20 bp, mouse
gagaagccacctaacctgac

SEQ ID NO: 849167 - DNA, 20 bp, mouse
gtcactcggcgccgcgcgaa

SEQ ID NO: 849168 - DNA, 20 bp, mouse
ggtccaggagcatgcgcgca

SEQ ID NO: 849169 - DNA, 20 bp, mouse
gtaggtggcttctcttggac

SEQ ID NO: 849170 - DNA, 20 bp, mouse
gaatcaccaaaggcaggtgg

SEQ ID NO: 849171 - DNA, 20 bp, mouse
gcgcgaacggcgtgccgtcc

SEQ ID NO: 849172 - DNA, 20 bp, mouse
gtctggacgtcgtgagtcac

SEQ ID NO: 849173 - DNA, 20 bp, mouse
ggcttctcttggacggggtc

SEQ ID NO: 849174 - DNA, 20 bp, mouse
ggcattcatggctacatatt

SEQ ID NO: 849175 - DNA, 20 bp, mouse
gaaagtcaatcaccaaaggc

SEQ ID NO: 849176 - DNA, 20 bp, mouse
gaatgcgcgcgcaaacgctt

SEQ ID NO: 849177 - DNA, 20 bp, mouse
gcaaacgcttgggtccacca

SEQ ID NO: 849178 - DNA, 20 bp, mouse
gtgggcaggcccaaatcgga

SEQ ID NO: 849179 - DNA, 20 bp, mouse
ggtggtgcgtgtgcacaagt

SEQ ID NO: 849180 - DNA, 20 bp, mouse
gttgcgcgcgcattctggga

SEQ ID NO: 849181 - DNA, 20 bp, mouse
ggcacaaatgccaagagcgg

SEQ ID NO: 849182 - DNA, 20 bp, mouse
gggcccacgggtgcagttaa

SEQ ID NO: 849183 - DNA, 20 bp, mouse
gtccgggcgctgaaggtaaa

SEQ ID NO: 849184 - DNA, 20 bp, mouse
gaattggtggactcagttag

SEQ ID NO: 849185 - DNA, 20 bp, mouse
gtgtgcacacgcaccacccc

SEQ ID NO: 849186 - DNA, 20 bp, mouse
gcgctcgggcgccccctagt

SEQ ID NO: 849187 - DNA, 20 bp, mouse
gtagacaagcgctggtcctg

SEQ ID NO: 849188 - DNA, 20 bp, mouse
ggcagcgcacgcccactagg

SEQ ID NO: 849189 - DNA, 20 bp, mouse
gaacgccactagattcgtcc

SEQ ID NO: 849190 - DNA, 20 bp, mouse
gcccacgcgcgtgctcactg

SEQ ID NO: 849191 - DNA, 20 bp, mouse
gagacttgctagtgtgttta

SEQ ID NO: 849192 - DNA, 20 bp, mouse
gcaggcacaccctctccatc

SEQ ID NO: 849193 - DNA, 20 bp, mouse
gaggggcgccgtagctacac

SEQ ID NO: 849194 - DNA, 20 bp, mouse
gtggtacagtccttattctg

SEQ ID NO: 849195 - DNA, 20 bp, mouse
ggcggttggcgcaagagctc

SEQ ID NO: 849196 - DNA, 20 bp, mouse
ggggcccaccctgtggacgg

SEQ ID NO: 849197 - DNA, 20 bp, mouse
gtcacgaccagccacttctt

SEQ ID NO: 849198 - DNA, 20 bp, mouse
ggagccaccgtccacagggt

SEQ ID NO: 849199 - DNA, 20 bp, mouse
gggtgggcccggctaaacgc

SEQ ID NO: 849200 - DNA, 20 bp, mouse
gcctgtggacggtggctcag

SEQ ID NO: 849201 - DNA, 20 bp, mouse
gagggaggaagtggggcgga

SEQ ID NO: 849202 - DNA, 20 bp, mouse
gcctgcgaaggaagcgcgag

SEQ ID NO: 849203 - DNA, 20 bp, mouse
gttcgcaggacaagttaaga

SEQ ID NO: 849204 - DNA, 20 bp, mouse
gacgctgagagcccaagaag

SEQ ID NO: 849205 - DNA, 20 bp, mouse
gaagtggctggtcgtgacgc

SEQ ID NO: 849206 - DNA, 20 bp, mouse
gccggccggtaaagcgtggg

SEQ ID NO: 849207 - DNA, 20 bp, mouse
gcggtaaagcgtgggcgggg

SEQ ID NO: 849208 - DNA, 20 bp, mouse
gcggccggccggtaaagcgt

SEQ ID NO: 849209 - DNA, 20 bp, mouse
gaggagaggccggaagtagt

SEQ ID NO: 849210 - DNA, 20 bp, mouse
gccggaagtagtgggaataa

SEQ ID NO: 849211 - DNA, 20 bp, mouse
ggctgtctgccaaaactccg

SEQ ID NO: 849212 - DNA, 20 bp, mouse
gagaactctctcaggatgaa

SEQ ID NO: 849213 - DNA, 20 bp, mouse
ggcggggggcggtcccagag

SEQ ID NO: 849214 - DNA, 20 bp, mouse
gaatggcgcaagcgtgttga

SEQ ID NO: 849215 - DNA, 20 bp, mouse
gacgcttgcgccattttgac

SEQ ID NO: 849216 - DNA, 20 bp, mouse
gaacggaagtgactcattct

SEQ ID NO: 849217 - DNA, 20 bp, mouse
gtccggaaaaagaatgaggg

SEQ ID NO: 849218 - DNA, 20 bp, mouse
ggaggactctactactgctc

SEQ ID NO: 849219 - DNA, 20 bp, mouse
gtctaagggaacccgggaaa

SEQ ID NO: 849220 - DNA, 20 bp, mouse
gaagaatgagggcggattag

SEQ ID NO: 849221 - DNA, 20 bp, mouse
gctccacaggtccgccaagt

SEQ ID NO: 849222 - DNA, 20 bp, mouse
gcacccacttggcggacctg

SEQ ID NO: 849223 - DNA, 20 bp, mouse
gaactcacggagagatagag

SEQ ID NO: 849224 - DNA, 20 bp, mouse
gcagtagtagagtcctccga

SEQ ID NO: 849225 - DNA, 20 bp, mouse
gagtcctccgagggaagttc

SEQ ID NO: 849226 - DNA, 20 bp, mouse
gcgggcgcgtccataagggg

SEQ ID NO: 849227 - DNA, 20 bp, mouse
gggcgggaagtaggtggcga

SEQ ID NO: 849228 - DNA, 20 bp, mouse
gactgcagggaagtaggtgg

SEQ ID NO: 849229 - DNA, 20 bp, mouse
ggacagacgcgtccactgca

SEQ ID NO: 849230 - DNA, 20 bp, mouse
gcgcaaccagcaagcgccga

SEQ ID NO: 849231 - DNA, 20 bp, mouse
gtcgccgggcgcgtccataa

SEQ ID NO: 849232 - DNA, 20 bp, mouse
gtctctccgcagcttcccct

SEQ ID NO: 849233 - DNA, 20 bp, mouse
gggaagctgcggagagagct

SEQ ID NO: 849234 - DNA, 20 bp, mouse
ggccccgcactcacacaagc

SEQ ID NO: 849235 - DNA, 20 bp, mouse
gcggggcaggacgcagccga

SEQ ID NO: 849236 - DNA, 20 bp, mouse
gagcccgggaggatcgcccg

SEQ ID NO: 849237 - DNA, 20 bp, mouse
gctcctcgggcgatcctccc

SEQ ID NO: 849238 - DNA, 20 bp, mouse
gacggcgctgattggatgaa

SEQ ID NO: 849239 - DNA, 20 bp, mouse
gccggcgccatgttaagtga

SEQ ID NO: 849240 - DNA, 20 bp, mouse
ggcgctgattggatgaaggg

SEQ ID NO: 849241 - DNA, 20 bp, mouse
ggaggcttcagacgccggta

SEQ ID NO: 849242 - DNA, 20 bp, mouse
gctaaaagactcggctcgag

SEQ ID NO: 849243 - DNA, 20 bp, mouse
gatgcctctgtgagcccggg

SEQ ID NO: 849244 - DNA, 20 bp, mouse
ggcgtgaagaggttagcgtt

SEQ ID NO: 849245 - DNA, 20 bp, mouse
gccgccgagctactactcaa

SEQ ID NO: 849246 - DNA, 20 bp, mouse
ggggccagcccaggagggta

SEQ ID NO: 849247 - DNA, 20 bp, mouse
gggccccgccctaccctcct

SEQ ID NO: 849248 - DNA, 20 bp, mouse
ggaggcggggcctaacacgg

SEQ ID NO: 849249 - DNA, 20 bp, mouse
gccagcccaggagggtaggg

SEQ ID NO: 849250 - DNA, 20 bp, mouse
gataagagcagagaaggcga

SEQ ID NO: 849251 - DNA, 20 bp, mouse
ggtcggaggcgggatcgggg

SEQ ID NO: 849252 - DNA, 20 bp, mouse
ggcgaggaggggtcctgagg

SEQ ID NO: 849253 - DNA, 20 bp, mouse
gctagaggcggggcctaaca

SEQ ID NO: 849254 - DNA, 20 bp, mouse
ggcggggcctaacacggggg

SEQ ID NO: 849255 - DNA, 20 bp, mouse
gatgactgtaaggagaatgt

SEQ ID NO: 849256 - DNA, 20 bp, mouse
ggggaacgctcttggaacca

SEQ ID NO: 849257 - DNA, 20 bp, mouse
gtggttgcgaggggaggcgc

SEQ ID NO: 849258 - DNA, 20 bp, mouse
ggatgtcccgccctactctg

SEQ ID NO: 849259 - DNA, 20 bp, mouse
gcctcccctcgcaaccagcc

SEQ ID NO: 849260 - DNA, 20 bp, mouse
gcggagaaatagcagcgtgt

SEQ ID NO: 849261 - DNA, 20 bp, mouse
gagtacgggcccccaagccc

SEQ ID NO: 849262 - DNA, 20 bp, mouse
gcacagaggtagaccagtac

SEQ ID NO: 849263 - DNA, 20 bp, mouse
gtagaaggtaggtagggcgt

SEQ ID NO: 849264 - DNA, 20 bp, mouse
gaggcgctgggacggccctg

SEQ ID NO: 849265 - DNA, 20 bp, mouse
ggaaatagcagcgtgtgggc

SEQ ID NO: 849266 - DNA, 20 bp, mouse
gactgtaaggacattggtta

SEQ ID NO: 849267 - DNA, 20 bp, mouse
ggacaggaaagataatttat

SEQ ID NO: 849268 - DNA, 20 bp, mouse
gaatatgtgttgataaggag

SEQ ID NO: 849269 - DNA, 20 bp, mouse
gaggacattggttagggagc

SEQ ID NO: 849270 - DNA, 20 bp, mouse
gtaaagaatatgtgttgata

SEQ ID NO: 849271 - DNA, 20 bp, mouse
ggttagtaattcttgagtgt

SEQ ID NO: 849272 - DNA, 20 bp, mouse
gtacttacatgaatttggac

SEQ ID NO: 849273 - DNA, 20 bp, mouse
gaaaagcaccttttactttt

SEQ ID NO: 849274 - DNA, 20 bp, mouse
gttctatacttacatgaatt

SEQ ID NO: 849275 - DNA, 20 bp, mouse
gggggattgaagagactgta

SEQ ID NO: 849276 - DNA, 20 bp, mouse
ggaggcggagcgccttaaag

SEQ ID NO: 849277 - DNA, 20 bp, mouse
ggggtcagaaaaactagagg

SEQ ID NO: 849278 - DNA, 20 bp, mouse
ggcgcgaggggcgggacaac

SEQ ID NO: 849279 - DNA, 20 bp, mouse
gacaccagtagcggtcaaat

SEQ ID NO: 849280 - DNA, 20 bp, mouse
gggacaacgggcggcgacga

SEQ ID NO: 849281 - DNA, 20 bp, mouse
gagggattgcgcgtgcgcga

SEQ ID NO: 849282 - DNA, 20 bp, mouse
gaagccccccgccttgcggt

SEQ ID NO: 849283 - DNA, 20 bp, mouse
gggcaggcacgggccagcac

SEQ ID NO: 849284 - DNA, 20 bp, mouse
ggtgttcggtaactgcagac

SEQ ID NO: 849285 - DNA, 20 bp, mouse
gaccacagacggccccttta

SEQ ID NO: 849286 - DNA, 20 bp, mouse
ggagtcgtccgtgtgccctg

SEQ ID NO: 849287 - DNA, 20 bp, mouse
gcgcctgctggtagtgatgt

SEQ ID NO: 849288 - DNA, 20 bp, mouse
ggggcacacggacgactctg

SEQ ID NO: 849289 - DNA, 20 bp, mouse
gaaccagatgacagagtatt

SEQ ID NO: 849290 - DNA, 20 bp, mouse
gaggcggagggacgttgcta

SEQ ID NO: 849291 - DNA, 20 bp, mouse
ggcaacgtccctccgcctgc

SEQ ID NO: 849292 - DNA, 20 bp, mouse
gtgcgacaccccccaccctc

SEQ ID NO: 849293 - DNA, 20 bp, mouse
gtgccttaggaccctttggc

SEQ ID NO: 849294 - DNA, 20 bp, mouse
gacccaaatactctgtcatc

SEQ ID NO: 849295 - DNA, 20 bp, mouse
gggcttctgtttcctgaggg

SEQ ID NO: 849296 - DNA, 20 bp, mouse
ggcgcgccccgcctcactga

SEQ ID NO: 849297 - DNA, 20 bp, mouse
ggatccgccatgcgagttga

SEQ ID NO: 849298 - DNA, 20 bp, mouse
gcgaggggcgggaacccgag

SEQ ID NO: 849299 - DNA, 20 bp, mouse
gagttgagggcaagaagcaa

SEQ ID NO: 849300 - DNA, 20 bp, mouse
gaactcgcatggcggatccc

SEQ ID NO: 849301 - DNA, 20 bp, mouse
gctgccgaacagtcacttcc

SEQ ID NO: 849302 - DNA, 20 bp, mouse
gctgcccggaagtgactgtt

SEQ ID NO: 849303 - DNA, 20 bp, mouse
gttccggcgcccgcgctgag

SEQ ID NO: 849304 - DNA, 20 bp, mouse
gcgagcggctggcgctgaaa

SEQ ID NO: 849305 - DNA, 20 bp, mouse
gtcgctccctaaagcttgat

SEQ ID NO: 849306 - DNA, 20 bp, mouse
gaggccccgctgagggtccc

SEQ ID NO: 849307 - DNA, 20 bp, mouse
gagggagtgcgcaagaactg

SEQ ID NO: 849308 - DNA, 20 bp, mouse
gtcacgaaaatgagtcacga

SEQ ID NO: 849309 - DNA, 20 bp, mouse
gcaacgatggagggtcctga

SEQ ID NO: 849310 - DNA, 20 bp, mouse
ggccactgcagctacaacga

SEQ ID NO: 849311 - DNA, 20 bp, mouse
gcgtcggtgcgtcgtctcta

SEQ ID NO: 849312 - DNA, 20 bp, mouse
gcctgtacctcggtccctga

SEQ ID NO: 849313 - DNA, 20 bp, mouse
gtggttgccgaggagaccgt

SEQ ID NO: 849314 - DNA, 20 bp, mouse
gctgcagctacaacgatgga

SEQ ID NO: 849315 - DNA, 20 bp, mouse
gacgcccagaggccgtgcgt

SEQ ID NO: 849316 - DNA, 20 bp, mouse
gccaagagaaaaaggagcta

SEQ ID NO: 849317 - DNA, 20 bp, mouse
gggatcggaagtgcactggg

SEQ ID NO: 849318 - DNA, 20 bp, mouse
gctcccggaagcaactgctt

SEQ ID NO: 849319 - DNA, 20 bp, mouse
gggaggatttcagaagaggc

SEQ ID NO: 849320 - DNA, 20 bp, mouse
ggcgggatcggaagtgcact

SEQ ID NO: 849321 - DNA, 20 bp, mouse
gaaggcactgcagaacgtat

SEQ ID NO: 849322 - DNA, 20 bp, mouse
gactgcagaacgtataggtg

SEQ ID NO: 849323 - DNA, 20 bp, mouse
gcacccttacgtacactcaa

SEQ ID NO: 849324 - DNA, 20 bp, mouse
gtggctgggggccggcggaa

SEQ ID NO: 849325 - DNA, 20 bp, mouse
gacacgaaaaaacctggctg

SEQ ID NO: 849326 - DNA, 20 bp, mouse
gaagaggcggggtctatcat

SEQ ID NO: 849327 - DNA, 20 bp, mouse
ggtactgatgacgaaatgaa

SEQ ID NO: 849328 - DNA, 20 bp, mouse
gcggcagccgcggggtgccc

SEQ ID NO: 849329 - DNA, 20 bp, mouse
gaccaggtctgccccaaaac

SEQ ID NO: 849330 - DNA, 20 bp, mouse
gtctcccccaaccacggacc

SEQ ID NO: 849331 - DNA, 20 bp, mouse
gctcacggcagggggcgtgt

SEQ ID NO: 849332 - DNA, 20 bp, mouse
gttggggcagacctggtccg

SEQ ID NO: 849333 - DNA, 20 bp, mouse
gggcagacctggtccgtggt

SEQ ID NO: 849334 - DNA, 20 bp, mouse
gcagttgtggtcaagtgaaa

SEQ ID NO: 849335 - DNA, 20 bp, mouse
gctgaactcaggctcttcct

SEQ ID NO: 849336 - DNA, 20 bp, mouse
gtctctcagggaaaaaaacc

SEQ ID NO: 849337 - DNA, 20 bp, mouse
gtagagcccaggacgacgct

SEQ ID NO: 849338 - DNA, 20 bp, mouse
ggctaggtacgcatcctgcc

SEQ ID NO: 849339 - DNA, 20 bp, mouse
gagaggctcaagtagagccc

SEQ ID NO: 849340 - DNA, 20 bp, mouse
gttggcagctaaactcagtc

SEQ ID NO: 849341 - DNA, 20 bp, mouse
gcgcagcaggcacttcatga

SEQ ID NO: 849342 - DNA, 20 bp, mouse
gagaaaatgcatgtctcctt

SEQ ID NO: 849343 - DNA, 20 bp, mouse
gcaggctgcgcacgcgccga

SEQ ID NO: 849344 - DNA, 20 bp, mouse
gcagctaaactcagtcgggg

SEQ ID NO: 849345 - DNA, 20 bp, mouse
ggcgtacctagcgtcgtcct

SEQ ID NO: 849346 - DNA, 20 bp, mouse
gtgggggggtgactctgatc

SEQ ID NO: 849347 - DNA, 20 bp, mouse
gtgggggacagggtcgtcat

SEQ ID NO: 849348 - DNA, 20 bp, mouse
gcaggagcgggatcgcgtgg

SEQ ID NO: 849349 - DNA, 20 bp, mouse
gaatcaggagcgggatcgcg

SEQ ID NO: 849350 - DNA, 20 bp, mouse
ggactctgatccggccaatc

SEQ ID NO: 849351 - DNA, 20 bp, mouse
ggtagcaaagccctggcgct

SEQ ID NO: 849352 - DNA, 20 bp, mouse
gctccgaagcccttagctac

SEQ ID NO: 849353 - DNA, 20 bp, mouse
gcgggatcgcgtgggggaca

SEQ ID NO: 849354 - DNA, 20 bp, mouse
gtagctcgccggcccctggc

SEQ ID NO: 849355 - DNA, 20 bp, mouse
gtccacacgggcatcactgt

SEQ ID NO: 849356 - DNA, 20 bp, mouse
gcaggcgcgcgtgctgggga

SEQ ID NO: 849357 - DNA, 20 bp, mouse
gcaactgtgagggtcaaaga

SEQ ID NO: 849358 - DNA, 20 bp, mouse
gttgacaacgagagatggga

SEQ ID NO: 849359 - DNA, 20 bp, mouse
gcgcgtgctggggacggccg

SEQ ID NO: 849360 - DNA, 20 bp, mouse
gctctcgttgtcaactgtga

SEQ ID NO: 849361 - DNA, 20 bp, mouse
gccttcggcccgttgctagg

SEQ ID NO: 849362 - DNA, 20 bp, mouse
gcggggacgccggccctcct

SEQ ID NO: 849363 - DNA, 20 bp, mouse
gcgtccccgcctcctagcaa

SEQ ID NO: 849364 - DNA, 20 bp, mouse
gacccaagtcgcagcaggcc

SEQ ID NO: 849365 - DNA, 20 bp, mouse
gacagttgacaacgagagat

SEQ ID NO: 849366 - DNA, 20 bp, mouse
gagtgggcggggagtaccta

SEQ ID NO: 849367 - DNA, 20 bp, mouse
gctgccttggcgtgcggggt

SEQ ID NO: 849368 - DNA, 20 bp, mouse
gcccgcccgcatcccaggag

SEQ ID NO: 849369 - DNA, 20 bp, mouse
gcccctgctgccttggcgtg

SEQ ID NO: 849370 - DNA, 20 bp, mouse
gctcgtggatgagctaacga

SEQ ID NO: 849371 - DNA, 20 bp, mouse
ggtcgtgctccactgacgtc

SEQ ID NO: 849372 - DNA, 20 bp, mouse
gccggtcccgcccgcatccc

SEQ ID NO: 849373 - DNA, 20 bp, mouse
gagggcagcctgctgctaac

SEQ ID NO: 849374 - DNA, 20 bp, mouse
gcccgcacgccaaggcagca

SEQ ID NO: 849375 - DNA, 20 bp, mouse
gtctgaagcctgttagcagc

SEQ ID NO: 849376 - DNA, 20 bp, mouse
gaagaggcggagctaaagga

SEQ ID NO: 849377 - DNA, 20 bp, mouse
gcccaatgggagataagagg

SEQ ID NO: 849378 - DNA, 20 bp, mouse
gttgcccaatgggagataag

SEQ ID NO: 849379 - DNA, 20 bp, mouse
ggggtaggctcattgcccaa

SEQ ID NO: 849380 - DNA, 20 bp, mouse
gacagcttgaataacttccc

SEQ ID NO: 849381 - DNA, 20 bp, mouse
gaatcacaaagcttccgggt

SEQ ID NO: 849382 - DNA, 20 bp, mouse
gggcggagctaaaggaaggt

SEQ ID NO: 849383 - DNA, 20 bp, mouse
gccaaagagccgtgggcttg

SEQ ID NO: 849384 - DNA, 20 bp, mouse
gtggccaatcacaaagcttc

SEQ ID NO: 849385 - DNA, 20 bp, mouse
gggtgccggctgcgtccaat

SEQ ID NO: 849386 - DNA, 20 bp, mouse
gtcaaagggaagttctcgtg

SEQ ID NO: 849387 - DNA, 20 bp, mouse
gagggagcaggatgcatcta

SEQ ID NO: 849388 - DNA, 20 bp, mouse
ggagaacttccctttgacta

SEQ ID NO: 849389 - DNA, 20 bp, mouse
gcatggacctaagtcaagag

SEQ ID NO: 849390 - DNA, 20 bp, mouse
gcggaactacaagtctccga

SEQ ID NO: 849391 - DNA, 20 bp, mouse
gtccttgctagtgggaaact

SEQ ID NO: 849392 - DNA, 20 bp, mouse
gcgggctggcagttgttgct

SEQ ID NO: 849393 - DNA, 20 bp, mouse
gccacctgacctcccttgta

SEQ ID NO: 849394 - DNA, 20 bp, mouse
gctgaagtggacgcaaggca

SEQ ID NO: 849395 - DNA, 20 bp, mouse
ggcttctctgggattacgtt

SEQ ID NO: 849396 - DNA, 20 bp, mouse
gaggcaggggtgttagtgaa

SEQ ID NO: 849397 - DNA, 20 bp, mouse
ggtaagtcccacagcagatt

SEQ ID NO: 849398 - DNA, 20 bp, mouse
gactctctgtagtaccttga

SEQ ID NO: 849399 - DNA, 20 bp, mouse
gagggtaaaggaaggaatcc

SEQ ID NO: 849400 - DNA, 20 bp, mouse
gttgggatccacctcctgca

SEQ ID NO: 849401 - DNA, 20 bp, mouse
ggtggatcccaatctgctgt

SEQ ID NO: 849402 - DNA, 20 bp, mouse
ggtagtaccttgagggagac

SEQ ID NO: 849403 - DNA, 20 bp, mouse
gtatggaagatgaacctgtg

SEQ ID NO: 849404 - DNA, 20 bp, mouse
gctaaaaggagccaaggata

SEQ ID NO: 849405 - DNA, 20 bp, mouse
gccatcatggggacttcatt

SEQ ID NO: 849406 - DNA, 20 bp, mouse
gtccgactctgaaagcggag

SEQ ID NO: 849407 - DNA, 20 bp, mouse
gccttccgccccgcgaggtt

SEQ ID NO: 849408 - DNA, 20 bp, mouse
ggagtggcagccgaacctcg

SEQ ID NO: 849409 - DNA, 20 bp, mouse
gagcggagctagcggggcag

SEQ ID NO: 849410 - DNA, 20 bp, mouse
gtggcctcagatcaagaggt

SEQ ID NO: 849411 - DNA, 20 bp, mouse
gtgcctggcctcagatcaag

SEQ ID NO: 849412 - DNA, 20 bp, mouse
ggcagccgaacctcgcgggg

SEQ ID NO: 849413 - DNA, 20 bp, mouse
gcggaggggtgtccatctcg

SEQ ID NO: 849414 - DNA, 20 bp, mouse
gcggcctacctcttgatctg

SEQ ID NO: 849415 - DNA, 20 bp, mouse
gggggcggaaggccgcgaga

SEQ ID NO: 849416 - DNA, 20 bp, mouse
gtgagctgctagcccggcag

SEQ ID NO: 849417 - DNA, 20 bp, mouse
gtgtaggggagtagctcttg

SEQ ID NO: 849418 - DNA, 20 bp, mouse
ggtcactagggagtatggac

SEQ ID NO: 849419 - DNA, 20 bp, mouse
gtggttggcaaccgtcacta

SEQ ID NO: 849420 - DNA, 20 bp, mouse
gccagaaagcggcctcgagg

SEQ ID NO: 849421 - DNA, 20 bp, mouse
ggagacctgctcaaaaaact

SEQ ID NO: 849422 - DNA, 20 bp, mouse
gtgcccagaaagcggcctcg

SEQ ID NO: 849423 - DNA, 20 bp, mouse
gtatggcaacggctagtcgc

SEQ ID NO: 849424 - DNA, 20 bp, mouse
gcaaccaagctccgtcccta

SEQ ID NO: 849425 - DNA, 20 bp, mouse
gagtcagaatcgccagtgta

SEQ ID NO: 849426 - DNA, 20 bp, mouse
ggcgactggagcccgctata

SEQ ID NO: 849427 - DNA, 20 bp, mouse
gagaccacgcctgcctggac

SEQ ID NO: 849428 - DNA, 20 bp, mouse
gaggcgtggtctggttacta

SEQ ID NO: 849429 - DNA, 20 bp, mouse
gccagggtggaaaacgctca

SEQ ID NO: 849430 - DNA, 20 bp, mouse
ggcgactgcgtccttatagc

SEQ ID NO: 849431 - DNA, 20 bp, mouse
gcgcccagtccaggcaggcg

SEQ ID NO: 849432 - DNA, 20 bp, mouse
gtaaccagaccacgcctgcc

SEQ ID NO: 849433 - DNA, 20 bp, mouse
gcaactcgcccagtccaggc

SEQ ID NO: 849434 - DNA, 20 bp, mouse
gcacctgaacccatacttcg

SEQ ID NO: 849435 - DNA, 20 bp, mouse
gggcctcaattgccgtaaat

SEQ ID NO: 849436 - DNA, 20 bp, mouse
gaagagcggcccggctgcgt

SEQ ID NO: 849437 - DNA, 20 bp, mouse
gaaaccaccgaaaggtttta

SEQ ID NO: 849438 - DNA, 20 bp, mouse
gcattccctccgcaccgcta

SEQ ID NO: 849439 - DNA, 20 bp, mouse
ggcgctgacaagccacgagg

SEQ ID NO: 849440 - DNA, 20 bp, mouse
gcgactcccggcaagcccga

SEQ ID NO: 849441 - DNA, 20 bp, mouse
gtcggactctcgccccctag

SEQ ID NO: 849442 - DNA, 20 bp, mouse
gtcgccccctagcggtgcgg

SEQ ID NO: 849443 - DNA, 20 bp, mouse
gcccaaactagacctcctcg

SEQ ID NO: 849444 - DNA, 20 bp, mouse
gaagtcctggcacgtttcta

SEQ ID NO: 849445 - DNA, 20 bp, mouse
ggccacgaggaggtctagtt

SEQ ID NO: 849446 - DNA, 20 bp, mouse
gcggcaggcaagtccactat

SEQ ID NO: 849447 - DNA, 20 bp, mouse
gtccctggaaagatcggccc

SEQ ID NO: 849448 - DNA, 20 bp, mouse
gtaggagggcggtgggaagc

SEQ ID NO: 849449 - DNA, 20 bp, mouse
gaaagatcggccctggtcag

SEQ ID NO: 849450 - DNA, 20 bp, mouse
gaccagggccgatctttcca

SEQ ID NO: 849451 - DNA, 20 bp, mouse
ggcgctgacccagctggctc

SEQ ID NO: 849452 - DNA, 20 bp, mouse
ggcactaagaactttaatga

SEQ ID NO: 849453 - DNA, 20 bp, mouse
gtccactataggagggcggt

SEQ ID NO: 849454 - DNA, 20 bp, mouse
gggcagacagaggccggtgg

SEQ ID NO: 849455 - DNA, 20 bp, mouse
gtcccaccgccctcctatag

SEQ ID NO: 849456 - DNA, 20 bp, mouse
gcgcgcctgcccaggaagtc

SEQ ID NO: 849457 - DNA, 20 bp, mouse
gtgcttgtagctgacatcga

SEQ ID NO: 849458 - DNA, 20 bp, mouse
gcgagagcgcgcgcctgccc

SEQ ID NO: 849459 - DNA, 20 bp, mouse
gtgtcagctacaagcaggat

SEQ ID NO: 849460 - DNA, 20 bp, mouse
ggcccaggaagtctggctgg

SEQ ID NO: 849461 - DNA, 20 bp, mouse
gtgggacactgacagctctt

SEQ ID NO: 849462 - DNA, 20 bp, mouse
gtagctgacatcgatggatc

SEQ ID NO: 849463 - DNA, 20 bp, mouse
gcgtggtcttccgctggctg

SEQ ID NO: 849464 - DNA, 20 bp, mouse
gggccagtctactgttacac

SEQ ID NO: 849465 - DNA, 20 bp, mouse
ggctgtcagtgtcccaaagc

SEQ ID NO: 849466 - DNA, 20 bp, mouse
gttacccccaaccttcaaaa

SEQ ID NO: 849467 - DNA, 20 bp, mouse
gctaaatgacagtttggggc

SEQ ID NO: 849468 - DNA, 20 bp, mouse
gaggggctaaatgacagttt

SEQ ID NO: 849469 - DNA, 20 bp, mouse
gtgtgcctttttgaaggttg

SEQ ID NO: 849470 - DNA, 20 bp, mouse
gcgccggaagtgcaagccac

SEQ ID NO: 849471 - DNA, 20 bp, mouse
gaaaatgtgtgcctttttga

SEQ ID NO: 849472 - DNA, 20 bp, mouse
gggattcagtctgacaactc

SEQ ID NO: 849473 - DNA, 20 bp, mouse
gggaagtgcaagccacgggc

SEQ ID NO: 849474 - DNA, 20 bp, mouse
gctcgctgatgatgcagtag

SEQ ID NO: 849475 - DNA, 20 bp, mouse
gtcagaggagtcggatctcc

SEQ ID NO: 849476 - DNA, 20 bp, mouse
ggggccgcgggcggaagagt

SEQ ID NO: 849477 - DNA, 20 bp, mouse
gaaactaaagatggcggcgt

SEQ ID NO: 849478 - DNA, 20 bp, mouse
gcaaaaaaaggcaacggagg

SEQ ID NO: 849479 - DNA, 20 bp, mouse
gaaagatggcggcgtaggcg

SEQ ID NO: 849480 - DNA, 20 bp, mouse
gcagaagagagttttctctt

SEQ ID NO: 849481 - DNA, 20 bp, mouse
gaaaaggcaacggcttcagt

SEQ ID NO: 849482 - DNA, 20 bp, mouse
gctgtatcgaatagctgtag

SEQ ID NO: 849483 - DNA, 20 bp, mouse
gcaggccagtcggcctatga

SEQ ID NO: 849484 - DNA, 20 bp, mouse
gctaaaggttccgccagaag

SEQ ID NO: 849485 - DNA, 20 bp, mouse
ggggctttactccttctaca

SEQ ID NO: 849486 - DNA, 20 bp, mouse
ggggcacagcctgtgggaca

SEQ ID NO: 849487 - DNA, 20 bp, mouse
ggccgaaagccctgtcccac

SEQ ID NO: 849488 - DNA, 20 bp, mouse
gacagaaacaacttccggta

SEQ ID NO: 849489 - DNA, 20 bp, mouse
gtgtcagttgcgcagctgtg

SEQ ID NO: 849490 - DNA, 20 bp, mouse
gcggatcgcttaaagggcta

SEQ ID NO: 849491 - DNA, 20 bp, mouse
gtggttcctctaccccctac

SEQ ID NO: 849492 - DNA, 20 bp, mouse
gaacttccggtagggggtag

SEQ ID NO: 849493 - DNA, 20 bp, mouse
ggagatactcaggatgaaag

SEQ ID NO: 849494 - DNA, 20 bp, mouse
ggcctgtgggacagggcttt

SEQ ID NO: 849495 - DNA, 20 bp, mouse
ggaggattgtgggtaatcgg

SEQ ID NO: 849496 - DNA, 20 bp, mouse
gtctcgcgatagtggggagg

SEQ ID NO: 849497 - DNA, 20 bp, mouse
gccgctgcggggacaggaga

SEQ ID NO: 849498 - DNA, 20 bp, mouse
gcccgacccgagcctgtcag

SEQ ID NO: 849499 - DNA, 20 bp, mouse
gacggaaaagcaggctggaa

SEQ ID NO: 849500 - DNA, 20 bp, mouse
gccagggccgacacccggga

SEQ ID NO: 849501 - DNA, 20 bp, mouse
gttagcgtagcagggtgact

SEQ ID NO: 849502 - DNA, 20 bp, mouse
gaaaatcccgctgcggggac

SEQ ID NO: 849503 - DNA, 20 bp, mouse
gtcttctcgcgatagtgggg

SEQ ID NO: 849504 - DNA, 20 bp, mouse
gggtgagagacgtagagcct

SEQ ID NO: 849505 - DNA, 20 bp, mouse
gggacaggagacggaaaagc

SEQ ID NO: 849506 - DNA, 20 bp, mouse
ggagactcgcagcctgggag

SEQ ID NO: 849507 - DNA, 20 bp, mouse
gggctgcaggcggatggatg

SEQ ID NO: 849508 - DNA, 20 bp, mouse
gctgcccgagtgtaccggga

SEQ ID NO: 849509 - DNA, 20 bp, mouse
gggccccggttcccgatcga

SEQ ID NO: 849510 - DNA, 20 bp, mouse
gggaagctcgggcgacgatt

SEQ ID NO: 849511 - DNA, 20 bp, mouse
gagctcgggcgacgattcgg

SEQ ID NO: 849512 - DNA, 20 bp, mouse
gtcgggcgacgattcggagg

SEQ ID NO: 849513 - DNA, 20 bp, mouse
ggggcggcgctctcccgtgg

SEQ ID NO: 849514 - DNA, 20 bp, mouse
gtggccgctcgaggtggagg

SEQ ID NO: 849515 - DNA, 20 bp, mouse
gtggatggggcgtctccagg

SEQ ID NO: 849516 - DNA, 20 bp, mouse
gctgagacgcggatctagtg

SEQ ID NO: 849517 - DNA, 20 bp, mouse
gcgaggctcgtttggttctg

SEQ ID NO: 849518 - DNA, 20 bp, mouse
gctcggacgaagccccctaa

SEQ ID NO: 849519 - DNA, 20 bp, mouse
ggagaggggagaaggtccag

SEQ ID NO: 849520 - DNA, 20 bp, mouse
ggaagccccctaaaggcagt

SEQ ID NO: 849521 - DNA, 20 bp, mouse
gtctgcaggagaaatcagag

SEQ ID NO: 849522 - DNA, 20 bp, mouse
ggagctgacacttggctaaa

SEQ ID NO: 849523 - DNA, 20 bp, mouse
gtgagagggtgtatgcctaa

SEQ ID NO: 849524 - DNA, 20 bp, mouse
ggaggaagatcatcctgaac

SEQ ID NO: 849525 - DNA, 20 bp, mouse
ggcttcgtccgaggctcgtt

SEQ ID NO: 849526 - DNA, 20 bp, mouse
ggggcggcctcccgttgctg

SEQ ID NO: 849527 - DNA, 20 bp, mouse
gagacaccagcgtctccccg

SEQ ID NO: 849528 - DNA, 20 bp, mouse
ggagctggagcccgcggttc

SEQ ID NO: 849529 - DNA, 20 bp, mouse
gttctggggtgtgaacctgc

SEQ ID NO: 849530 - DNA, 20 bp, mouse
ggtcctgccctcgagagaga

SEQ ID NO: 849531 - DNA, 20 bp, mouse
gagctccggggcctcagcaa

SEQ ID NO: 849532 - DNA, 20 bp, mouse
gccggggcctcagcaacggg

SEQ ID NO: 849533 - DNA, 20 bp, mouse
gggcgggacgatgacgtcag

SEQ ID NO: 849534 - DNA, 20 bp, mouse
gggcttgagagcacccacaa

SEQ ID NO: 849535 - DNA, 20 bp, mouse
gggttcacaccccagaaccg

SEQ ID NO: 849536 - DNA, 20 bp, mouse
gacgactctcagccagaaaa

SEQ ID NO: 849537 - DNA, 20 bp, mouse
gctggaaagtaggaagtcta

SEQ ID NO: 849538 - DNA, 20 bp, mouse
gaaaaggccaaaacagttcc

SEQ ID NO: 849539 - DNA, 20 bp, mouse
gcgggcgtgggaatgaagga

SEQ ID NO: 849540 - DNA, 20 bp, mouse
ggttcccaatagcagtgaga

SEQ ID NO: 849541 - DNA, 20 bp, mouse
gaaaacagttcctggaaagt

SEQ ID NO: 849542 - DNA, 20 bp, mouse
gcgtccctctcactgctatt

SEQ ID NO: 849543 - DNA, 20 bp, mouse
gctattgggaacagaagcgc

SEQ ID NO: 849544 - DNA, 20 bp, mouse
gaagagcaacttccgggcgt

SEQ ID NO: 849545 - DNA, 20 bp, mouse
gcttccgggcgtgggaatga

SEQ ID NO: 849546 - DNA, 20 bp, mouse
gtggaaacggtccccaacga

SEQ ID NO: 849547 - DNA, 20 bp, mouse
gggcgcgcggcccgaaaagt

SEQ ID NO: 849548 - DNA, 20 bp, mouse
gagggctgcgggctgggtat

SEQ ID NO: 849549 - DNA, 20 bp, mouse
ggactccctggtcgtcctcc

SEQ ID NO: 849550 - DNA, 20 bp, mouse
gtgttcccggaggacgacca

SEQ ID NO: 849551 - DNA, 20 bp, mouse
gagagcccaaggcaagaagg

SEQ ID NO: 849552 - DNA, 20 bp, mouse
gagcttctgcccttcatcgg

SEQ ID NO: 849553 - DNA, 20 bp, mouse
ggcggcccgaaaagtgggag

SEQ ID NO: 849554 - DNA, 20 bp, mouse
gtacatgaagcacgtggaaa

SEQ ID NO: 849555 - DNA, 20 bp, mouse
gctatccgggtccctcgttg

SEQ ID NO: 849556 - DNA, 20 bp, mouse
gctaccttccgattggacga

SEQ ID NO: 849557 - DNA, 20 bp, mouse
gaggccggaccataaccagc

SEQ ID NO: 849558 - DNA, 20 bp, mouse
gcctagagggaggtgttgta

SEQ ID NO: 849559 - DNA, 20 bp, mouse
gccgccctccggctctgatt

SEQ ID NO: 849560 - DNA, 20 bp, mouse
gtggtccatagcacagaggc

SEQ ID NO: 849561 - DNA, 20 bp, mouse
gcaacacctccctctaggtc

SEQ ID NO: 849562 - DNA, 20 bp, mouse
gctgccctcgtccaatcgga

SEQ ID NO: 849563 - DNA, 20 bp, mouse
gccgcatgaaaaggcggaat

SEQ ID NO: 849564 - DNA, 20 bp, mouse
gccttctgccctcgtccaat

SEQ ID NO: 849565 - DNA, 20 bp, mouse
ggagcccgctggttatggtc

SEQ ID NO: 849566 - DNA, 20 bp, mouse
gcgagcccacgcaagaccta

SEQ ID NO: 849567 - DNA, 20 bp, mouse
gaggcaacagcggtggaagt

SEQ ID NO: 849568 - DNA, 20 bp, mouse
gaggcccctaggtcttgcgt

SEQ ID NO: 849569 - DNA, 20 bp, mouse
gaggccgcaaagccccaagc

SEQ ID NO: 849570 - DNA, 20 bp, mouse
gcccgctgctgcgtggtcct

SEQ ID NO: 849571 - DNA, 20 bp, mouse
gaagcaggaggcaacagcgg

SEQ ID NO: 849572 - DNA, 20 bp, mouse
gcaagacctaggggcctgct

SEQ ID NO: 849573 - DNA, 20 bp, mouse
ggcccaggaccacgcagcag

SEQ ID NO: 849574 - DNA, 20 bp, mouse
gggggcctcagcactgtgca

SEQ ID NO: 849575 - DNA, 20 bp, mouse
ggcgagacgcgctgtcgtca

SEQ ID NO: 849576 - DNA, 20 bp, mouse
gcgggagctggctgagagta

SEQ ID NO: 849577 - DNA, 20 bp, mouse
gacggggcggagcctatctc

SEQ ID NO: 849578 - DNA, 20 bp, mouse
gagccagctcccgggcgtct

SEQ ID NO: 849579 - DNA, 20 bp, mouse
ggcggggcggagcgcaaggt

SEQ ID NO: 849580 - DNA, 20 bp, mouse
gagcgcaaggttggtaggtt

SEQ ID NO: 849581 - DNA, 20 bp, mouse
gtcagcaagccgagacgccc

SEQ ID NO: 849582 - DNA, 20 bp, mouse
gcggggctacagggggagat

SEQ ID NO: 849583 - DNA, 20 bp, mouse
gcgtacgaggcgcccgagat

SEQ ID NO: 849584 - DNA, 20 bp, mouse
gcgctcagggcggaggggcg

SEQ ID NO: 849585 - DNA, 20 bp, mouse
gctacagggggagatgggcg

SEQ ID NO: 849586 - DNA, 20 bp, mouse
gtgtggagaagcatctgttg

SEQ ID NO: 849587 - DNA, 20 bp, mouse
gcatgccaggggcctaaggc

SEQ ID NO: 849588 - DNA, 20 bp, mouse
ggtaaagactgtgaatgctt

SEQ ID NO: 849589 - DNA, 20 bp, mouse
gaaggcttccgggtagaatg

SEQ ID NO: 849590 - DNA, 20 bp, mouse
gcttcggctgcgagcgtatg

SEQ ID NO: 849591 - DNA, 20 bp, mouse
gggaccccgcctaggaaaag

SEQ ID NO: 849592 - DNA, 20 bp, mouse
ggctcacacggcattttcgg

SEQ ID NO: 849593 - DNA, 20 bp, mouse
ggagacgcaaagcaccggaa

SEQ ID NO: 849594 - DNA, 20 bp, mouse
gcaatccagccttaggcccc

SEQ ID NO: 849595 - DNA, 20 bp, mouse
gtgtctatgtaaagtcgttg

SEQ ID NO: 849596 - DNA, 20 bp, mouse
gcgtcccaggggacccacga

SEQ ID NO: 849597 - DNA, 20 bp, mouse
ggggaccggcgacgtcccag

SEQ ID NO: 849598 - DNA, 20 bp, mouse
ggttgcgcccgctccctcgt

SEQ ID NO: 849599 - DNA, 20 bp, mouse
ggcaacgcgtggctgtgggt

SEQ ID NO: 849600 - DNA, 20 bp, mouse
gcgggcgcaacgcgtggctg

SEQ ID NO: 849601 - DNA, 20 bp, mouse
ggggtcccctgggacgtcgc

SEQ ID NO: 849602 - DNA, 20 bp, mouse
gactcggatgaaggcgtcca

SEQ ID NO: 849603 - DNA, 20 bp, mouse
ggggacgtcgccggtcccgg

SEQ ID NO: 849604 - DNA, 20 bp, mouse
gagggagcgggcgcaacgcg

SEQ ID NO: 849605 - DNA, 20 bp, mouse
gggtgtgcccacccccgtgt

SEQ ID NO: 849606 - DNA, 20 bp, mouse
gggtaccagtcatacaacac

SEQ ID NO: 849607 - DNA, 20 bp, mouse
gggtatgcttcactgggagg

SEQ ID NO: 849608 - DNA, 20 bp, mouse
gactggtacctggggacagg

SEQ ID NO: 849609 - DNA, 20 bp, mouse
gaaagcgcggtatgcttcac

SEQ ID NO: 849610 - DNA, 20 bp, mouse
gtagacccgtgttgtatgac

SEQ ID NO: 849611 - DNA, 20 bp, mouse
gatgactggtacctggggac

SEQ ID NO: 849612 - DNA, 20 bp, mouse
gtaggtaactaactgttggg

SEQ ID NO: 849613 - DNA, 20 bp, mouse
ggttgaagtagagaaaaaga

SEQ ID NO: 849614 - DNA, 20 bp, mouse
gccccccccgcccccttaaa

SEQ ID NO: 849615 - DNA, 20 bp, mouse
gaaatgttcacttgaggcat

SEQ ID NO: 849616 - DNA, 20 bp, mouse
ggaccctgggtcgtggatgc

SEQ ID NO: 849617 - DNA, 20 bp, mouse
gggcgagcgaagccgagcgg

SEQ ID NO: 849618 - DNA, 20 bp, mouse
gctcgccgctcgcccatagg

SEQ ID NO: 849619 - DNA, 20 bp, mouse
gctccagcatccacgaccca

SEQ ID NO: 849620 - DNA, 20 bp, mouse
gcggccgggccaaggagtaa

SEQ ID NO: 849621 - DNA, 20 bp, mouse
ggacccagggtcccaccgct

SEQ ID NO: 849622 - DNA, 20 bp, mouse
gcaaagggtgaggggcacaa

SEQ ID NO: 849623 - DNA, 20 bp, mouse
gcccgccagccaatgggcgc

SEQ ID NO: 849624 - DNA, 20 bp, mouse
gtcgctcgccgctcgcccat

SEQ ID NO: 849625 - DNA, 20 bp, mouse
gagccgagcggtgggaccct

SEQ ID NO: 849626 - DNA, 20 bp, mouse
gggcacgcatgcgcgggcat

SEQ ID NO: 849627 - DNA, 20 bp, mouse
gcggtaggccggttccctgt

SEQ ID NO: 849628 - DNA, 20 bp, mouse
gtgcgtgcccgcggcagctc

SEQ ID NO: 849629 - DNA, 20 bp, mouse
gcatgcgcgggcatgggcgc

SEQ ID NO: 849630 - DNA, 20 bp, mouse
ggatagagatctaagtacga

SEQ ID NO: 849631 - DNA, 20 bp, mouse
gcgcgggcatgggcgcgggg

SEQ ID NO: 849632 - DNA, 20 bp, mouse
gcggcctaccggagctgccg

SEQ ID NO: 849633 - DNA, 20 bp, mouse
gaacacgtgacccagtgagt

SEQ ID NO: 849634 - DNA, 20 bp, mouse
ggcccgcgcatgcgtgcccg

SEQ ID NO: 849635 - DNA, 20 bp, mouse
ggtgggcgtggctgcggcgc

SEQ ID NO: 849636 - DNA, 20 bp, mouse
gtgaccgggcgcgcgatgga

SEQ ID NO: 849637 - DNA, 20 bp, mouse
gcccccgctagcaggttagt

SEQ ID NO: 849638 - DNA, 20 bp, mouse
gggagccccccacttcgccg

SEQ ID NO: 849639 - DNA, 20 bp, mouse
ggggcccgcgctcactattc

SEQ ID NO: 849640 - DNA, 20 bp, mouse
gcgcgatggagggggggtga

SEQ ID NO: 849641 - DNA, 20 bp, mouse
ggcgcccactaacctgctag

SEQ ID NO: 849642 - DNA, 20 bp, mouse
gcggtgaagccgattggccc

SEQ ID NO: 849643 - DNA, 20 bp, mouse
gaccggcagcagacgttgac

SEQ ID NO: 849644 - DNA, 20 bp, mouse
gcgcgggaacggcagccagt

SEQ ID NO: 849645 - DNA, 20 bp, mouse
gccgggcgcgcgatggaggg

SEQ ID NO: 849646 - DNA, 20 bp, mouse
ggggcgaggctggtggagag

SEQ ID NO: 849647 - DNA, 20 bp, mouse
gagaatgagtgggatctgag

SEQ ID NO: 849648 - DNA, 20 bp, mouse
gggctgggaatgcgaatctt

SEQ ID NO: 849649 - DNA, 20 bp, mouse
gagtgggatctgaggggggt

SEQ ID NO: 849650 - DNA, 20 bp, mouse
gcgtagctcaagaacaggtt

SEQ ID NO: 849651 - DNA, 20 bp, mouse
gacgaagcctgcgtggttcc

SEQ ID NO: 849652 - DNA, 20 bp, mouse
gggggccccgtgcagcgtga

SEQ ID NO: 849653 - DNA, 20 bp, mouse
gagatcccactcattctctc

SEQ ID NO: 849654 - DNA, 20 bp, mouse
gctagtcgccctcccatgga

SEQ ID NO: 849655 - DNA, 20 bp, mouse
gcgcccacccggaaccacgc

SEQ ID NO: 849656 - DNA, 20 bp, mouse
ggggagccgccctgcgagga

SEQ ID NO: 849657 - DNA, 20 bp, mouse
gtaggcgcgccgccagtcgt

SEQ ID NO: 849658 - DNA, 20 bp, mouse
gagggcgcgacgtagcccac

SEQ ID NO: 849659 - DNA, 20 bp, mouse
gtagctggttcctcccccgt

SEQ ID NO: 849660 - DNA, 20 bp, mouse
ggcatcccgggccaatgagt

SEQ ID NO: 849661 - DNA, 20 bp, mouse
gtggcggcgcgcctaggctg

SEQ ID NO: 849662 - DNA, 20 bp, mouse
ggcgacccgcccacgactgg

SEQ ID NO: 849663 - DNA, 20 bp, mouse
gtcgcagggcggctcccggc

SEQ ID NO: 849664 - DNA, 20 bp, mouse
gcacgacggggcgacggcga

SEQ ID NO: 849665 - DNA, 20 bp, mouse
ggcgcgccgccagtcgtggg

SEQ ID NO: 849666 - DNA, 20 bp, mouse
gtttgcctggggagggaact

SEQ ID NO: 849667 - DNA, 20 bp, mouse
gaaactctagggcgctcctt

SEQ ID NO: 849668 - DNA, 20 bp, mouse
gagaagtctaacagggagag

SEQ ID NO: 849669 - DNA, 20 bp, mouse
gttagctagcgctgattggg

SEQ ID NO: 849670 - DNA, 20 bp, mouse
gtgtaattaagaagtctaac

SEQ ID NO: 849671 - DNA, 20 bp, mouse
gggcaagacgcgaaactcta

SEQ ID NO: 849672 - DNA, 20 bp, mouse
ggattgggtgggtgcttccc

SEQ ID NO: 849673 - DNA, 20 bp, mouse
gttgggtcacggggaatcag

SEQ ID NO: 849674 - DNA, 20 bp, mouse
gactgaccctggaagtggtg

SEQ ID NO: 849675 - DNA, 20 bp, mouse
ggaggaaaggcggcgcacag

SEQ ID NO: 849676 - DNA, 20 bp, mouse
ggctgagggcacaagatccc

SEQ ID NO: 849677 - DNA, 20 bp, mouse
ggaccctgtgtggaggacca

SEQ ID NO: 849678 - DNA, 20 bp, mouse
ggtcctccacacagggtccc

SEQ ID NO: 849679 - DNA, 20 bp, mouse
ggagaaccaaccactaccca

SEQ ID NO: 849680 - DNA, 20 bp, mouse
ggtccctcccggccacgtct

SEQ ID NO: 849681 - DNA, 20 bp, mouse
ggcaccagccaagacgtggc

SEQ ID NO: 849682 - DNA, 20 bp, mouse
gagggaccatagcctgggtg

SEQ ID NO: 849683 - DNA, 20 bp, mouse
gcagccttggtcctccacac

SEQ ID NO: 849684 - DNA, 20 bp, mouse
gttacagtcactctagtcac

SEQ ID NO: 849685 - DNA, 20 bp, mouse
gtcctggggcagacagtcac

SEQ ID NO: 849686 - DNA, 20 bp, mouse
gagggcaaggggcaagaaaa

SEQ ID NO: 849687 - DNA, 20 bp, mouse
gaagctgtgagtcttagggt

SEQ ID NO: 849688 - DNA, 20 bp, mouse
gccacagagaaaaagggcaa

SEQ ID NO: 849689 - DNA, 20 bp, mouse
gctaccaacaatcccggctc

SEQ ID NO: 849690 - DNA, 20 bp, mouse
gaattatgttagcgcgaaga

SEQ ID NO: 849691 - DNA, 20 bp, mouse
gtcacgatatatatagttta

SEQ ID NO: 849692 - DNA, 20 bp, mouse
ggagccagagccgggattgt

SEQ ID NO: 849693 - DNA, 20 bp, mouse
ggcctctgctggccaaatca

SEQ ID NO: 849694 - DNA, 20 bp, mouse
gaaggctctcagggtcctgc

SEQ ID NO: 849695 - DNA, 20 bp, mouse
gagaggccccgtcctgctgt

SEQ ID NO: 849696 - DNA, 20 bp, mouse
gcaggcttctgcatgtgata

SEQ ID NO: 849697 - DNA, 20 bp, mouse
gatagggaagggagtcgggt

SEQ ID NO: 849698 - DNA, 20 bp, mouse
gctacctcagatcttaaggt

SEQ ID NO: 849699 - DNA, 20 bp, mouse
ggggtgggtgcatcttgttc

SEQ ID NO: 849700 - DNA, 20 bp, mouse
ggcagaagcctgggtcatgt

SEQ ID NO: 849701 - DNA, 20 bp, mouse
ggtacccaccttaagatctg

SEQ ID NO: 849702 - DNA, 20 bp, mouse
gaggctggacagacaggtca

SEQ ID NO: 849703 - DNA, 20 bp, mouse
gtcctcgctgcaggcagagt

SEQ ID NO: 849704 - DNA, 20 bp, mouse
gtctcacacccacatgaccc

SEQ ID NO: 849705 - DNA, 20 bp, mouse
gaaagcaggaaacagacacg

SEQ ID NO: 849706 - DNA, 20 bp, mouse
gggtcctgccacgtgccgcc

SEQ ID NO: 849707 - DNA, 20 bp, mouse
gcgccaggctgtgtgtccta

SEQ ID NO: 849708 - DNA, 20 bp, mouse
gggcgggccaccccgaaaga

SEQ ID NO: 849709 - DNA, 20 bp, mouse
gatggtggccatttctgaca

SEQ ID NO: 849710 - DNA, 20 bp, mouse
gagtgacagagccctccttg

SEQ ID NO: 849711 - DNA, 20 bp, mouse
gccaagtccctccctcaaaa

SEQ ID NO: 849712 - DNA, 20 bp, mouse
ggaaggtttgctgatgacag

SEQ ID NO: 849713 - DNA, 20 bp, mouse
gagacttcttgtgcaaacag

SEQ ID NO: 849714 - DNA, 20 bp, mouse
ggaaatggccaccattttga

SEQ ID NO: 849715 - DNA, 20 bp, mouse
ggctgggcgtggcaatgggc

SEQ ID NO: 849716 - DNA, 20 bp, mouse
gacacaatcggggatgggga

SEQ ID NO: 849717 - DNA, 20 bp, mouse
ggacctgcccctgtagggca

SEQ ID NO: 849718 - DNA, 20 bp, mouse
ggtagggcagggctaggagt

SEQ ID NO: 849719 - DNA, 20 bp, mouse
ggcacacacaatcggggatg

SEQ ID NO: 849720 - DNA, 20 bp, mouse
gtcctagccctgccctacag

SEQ ID NO: 849721 - DNA, 20 bp, mouse
ggcagggctaggagttggtt

SEQ ID NO: 849722 - DNA, 20 bp, mouse
gaacaggacctgcccctgta

SEQ ID NO: 849723 - DNA, 20 bp, mouse
gttccacatgagaggatgaa

SEQ ID NO: 849724 - DNA, 20 bp, mouse
gtggggatgtagatcaggcc

SEQ ID NO: 849725 - DNA, 20 bp, mouse
gcattcttaaagtgactctc

SEQ ID NO: 849726 - DNA, 20 bp, mouse
gcatcaacccggaacaggaa

SEQ ID NO: 849727 - DNA, 20 bp, mouse
gtctggctacaggataagtg

SEQ ID NO: 849728 - DNA, 20 bp, mouse
gtgtaaaaagagttaggcgt

SEQ ID NO: 849729 - DNA, 20 bp, mouse
gttcttcttagggactagca

SEQ ID NO: 849730 - DNA, 20 bp, mouse
ggggactagcagggctagtc

SEQ ID NO: 849731 - DNA, 20 bp, mouse
ggttaggcgtggggcttgaa

SEQ ID NO: 849732 - DNA, 20 bp, mouse
gcatacctgagcagtatttg

SEQ ID NO: 849733 - DNA, 20 bp, mouse
gaagtgcatcaacccggaac

SEQ ID NO: 849734 - DNA, 20 bp, mouse
gaaacggaagtgcatcaacc

SEQ ID NO: 849735 - DNA, 20 bp, mouse
gagacaatgtcttcttctta

SEQ ID NO: 849736 - DNA, 20 bp, mouse
gttagggcatgggtacaaga

SEQ ID NO: 849737 - DNA, 20 bp, mouse
ggaaaacgagagaacaaagg

SEQ ID NO: 849738 - DNA, 20 bp, mouse
gtcttcgtgggtaagtctta

SEQ ID NO: 849739 - DNA, 20 bp, mouse
ggagagaacaaaggtggcat

SEQ ID NO: 849740 - DNA, 20 bp, mouse
gaaaacagactggtccacgg

SEQ ID NO: 849741 - DNA, 20 bp, mouse
gcctgtcagtgtaccacact

SEQ ID NO: 849742 - DNA, 20 bp, mouse
gcgagaaaacgagagaacaa

SEQ ID NO: 849743 - DNA, 20 bp, mouse
ggaactttgctaatcctttg

SEQ ID NO: 849744 - DNA, 20 bp, mouse
gtagaaataaacgtggaggg

SEQ ID NO: 849745 - DNA, 20 bp, mouse
gtcatgagacaataagagca

SEQ ID NO: 849746 - DNA, 20 bp, mouse
gctgcagagtcgttgttcca

SEQ ID NO: 849747 - DNA, 20 bp, mouse
gcctgggtgtccttttctcc

SEQ ID NO: 849748 - DNA, 20 bp, mouse
gtgggagggccgccctcaga

SEQ ID NO: 849749 - DNA, 20 bp, mouse
gccagtcttgatgcacagtc

SEQ ID NO: 849750 - DNA, 20 bp, mouse
ggagtcgttgttccaaggat

SEQ ID NO: 849751 - DNA, 20 bp, mouse
ggttctgaatgacgcaaacc

SEQ ID NO: 849752 - DNA, 20 bp, mouse
gctgaatgccccctacatga

SEQ ID NO: 849753 - DNA, 20 bp, mouse
gtcgaactcaagacctcctc

SEQ ID NO: 849754 - DNA, 20 bp, mouse
gttgcgtcattcagaacact

SEQ ID NO: 849755 - DNA, 20 bp, mouse
gctacatgaaggctgtgagg

SEQ ID NO: 849756 - DNA, 20 bp, mouse
gaaccctgtgatgcctacat

SEQ ID NO: 849757 - DNA, 20 bp, mouse
gtgagcgctggagatcattt

SEQ ID NO: 849758 - DNA, 20 bp, mouse
gatagggcagaaaacctgga

SEQ ID NO: 849759 - DNA, 20 bp, mouse
gcacccatgtaggcatcaca

SEQ ID NO: 849760 - DNA, 20 bp, mouse
gccatcatgggctccatcac

SEQ ID NO: 849761 - DNA, 20 bp, mouse
gcttagttattcattaccta

SEQ ID NO: 849762 - DNA, 20 bp, mouse
gctccagaaaaatcatatta

SEQ ID NO: 849763 - DNA, 20 bp, mouse
gtttgatagggcagaaaacc

SEQ ID NO: 849764 - DNA, 20 bp, mouse
gtccatcacagctccatcat

SEQ ID NO: 849765 - DNA, 20 bp, mouse
gccagtgaacacacccatgt

SEQ ID NO: 849766 - DNA, 20 bp, mouse
ggggccctgacactccttac

SEQ ID NO: 849767 - DNA, 20 bp, mouse
ggagtgtcagggcccactgg

SEQ ID NO: 849768 - DNA, 20 bp, mouse
gcagccagtaaggagtgtca

SEQ ID NO: 849769 - DNA, 20 bp, mouse
gggaaaaaggaacctggtga

SEQ ID NO: 849770 - DNA, 20 bp, mouse
gtgtgtctcacagtaagagc

SEQ ID NO: 849771 - DNA, 20 bp, mouse
ggaaactggaaaaaggaacc

SEQ ID NO: 849772 - DNA, 20 bp, mouse
gtgtaacaactcacatggta

SEQ ID NO: 849773 - DNA, 20 bp, mouse
gtcaactgacccttgccaat

SEQ ID NO: 849774 - DNA, 20 bp, mouse
gcagttgaaagtaagtaggc

SEQ ID NO: 849775 - DNA, 20 bp, mouse
gaatgacttccaattggcaa

SEQ ID NO: 849776 - DNA, 20 bp, mouse
gaatgtagaagcatgggtgt

SEQ ID NO: 849777 - DNA, 20 bp, mouse
gtgggaggaggcagtcaatc

SEQ ID NO: 849778 - DNA, 20 bp, mouse
ggccaagcagtgatgtaaag

SEQ ID NO: 849779 - DNA, 20 bp, mouse
gacttcaaactgattggggt

SEQ ID NO: 849780 - DNA, 20 bp, mouse
gagaaaaaacagctttccag

SEQ ID NO: 849781 - DNA, 20 bp, mouse
gagttctcagcatacgccac

SEQ ID NO: 849782 - DNA, 20 bp, mouse
gtagagtattgttcctaggt

SEQ ID NO: 849783 - DNA, 20 bp, mouse
gtacatcactgcttggctct

SEQ ID NO: 849784 - DNA, 20 bp, mouse
gcaattagagtattgttcct

SEQ ID NO: 849785 - DNA, 20 bp, mouse
gcagagacttcaaactgatt

SEQ ID NO: 849786 - DNA, 20 bp, mouse
gggaggggtggacaagtgtc

SEQ ID NO: 849787 - DNA, 20 bp, mouse
ggccgagtgaggggtacagg

SEQ ID NO: 849788 - DNA, 20 bp, mouse
gaggcgggtaggaagcacag

SEQ ID NO: 849789 - DNA, 20 bp, mouse
gcttggctctggtgggaacc

SEQ ID NO: 849790 - DNA, 20 bp, mouse
gaccgagacagcttccaagc

SEQ ID NO: 849791 - DNA, 20 bp, mouse
gcaggtgtcattcttggctc

SEQ ID NO: 849792 - DNA, 20 bp, mouse
gacaagtgtccggctgcagc

SEQ ID NO: 849793 - DNA, 20 bp, mouse
gagcactcgcgcggggaggg

SEQ ID NO: 849794 - DNA, 20 bp, mouse
gctggatcaggtgtcattct

SEQ ID NO: 849795 - DNA, 20 bp, mouse
ggccggcttggaagctgtct

SEQ ID NO: 849796 - DNA, 20 bp, mouse
ggcgccctcaccgtgagaac

SEQ ID NO: 849797 - DNA, 20 bp, mouse
ggggcgctcccgtgacgtca

SEQ ID NO: 849798 - DNA, 20 bp, mouse
ggcccgcgggcgaaagaacg

SEQ ID NO: 849799 - DNA, 20 bp, mouse
ggtgtcgccagtcgccccca

SEQ ID NO: 849800 - DNA, 20 bp, mouse
gcagccggttctcacggtga

SEQ ID NO: 849801 - DNA, 20 bp, mouse
gagtcgagctgaggttgttg

SEQ ID NO: 849802 - DNA, 20 bp, mouse
ggcgacaccgagcagccgcg

SEQ ID NO: 849803 - DNA, 20 bp, mouse
ggcgggccagccggttctca

SEQ ID NO: 849804 - DNA, 20 bp, mouse
gagggcgcccgggcgaggcc

SEQ ID NO: 849805 - DNA, 20 bp, mouse
gcgcacgcgcgtcgcgcttc

SEQ ID NO: 849806 - DNA, 20 bp, mouse
gggtgggagggacccagatc

SEQ ID NO: 849807 - DNA, 20 bp, mouse
gtcagcagaagaggactaga

SEQ ID NO: 849808 - DNA, 20 bp, mouse
ggaggccaagtcagcaatac

SEQ ID NO: 849809 - DNA, 20 bp, mouse
gtctgctgactcaactgctc

SEQ ID NO: 849810 - DNA, 20 bp, mouse
gatggctgtagtcaggcaga

SEQ ID NO: 849811 - DNA, 20 bp, mouse
gcctgatgtccttagggcaa

SEQ ID NO: 849812 - DNA, 20 bp, mouse
gcccctgcctgatgtcctta

SEQ ID NO: 849813 - DNA, 20 bp, mouse
ggactagagggtgaccaggg

SEQ ID NO: 849814 - DNA, 20 bp, mouse
gcacgtggccggctctgcct

SEQ ID NO: 849815 - DNA, 20 bp, mouse
ggatccatgtccctaacaca

SEQ ID NO: 849816 - DNA, 20 bp, mouse
gccaaggtaggactggtcgt

SEQ ID NO: 849817 - DNA, 20 bp, mouse
ggcctgcccagtccagaatc

SEQ ID NO: 849818 - DNA, 20 bp, mouse
gcgtggaaggcagccaaggt

SEQ ID NO: 849819 - DNA, 20 bp, mouse
gagtaaggagcacacgtcca

SEQ ID NO: 849820 - DNA, 20 bp, mouse
gtgccacccggattctggac

SEQ ID NO: 849821 - DNA, 20 bp, mouse
ggcggggagggttgcagaac

SEQ ID NO: 849822 - DNA, 20 bp, mouse
gagcagtgccacccggattc

SEQ ID NO: 849823 - DNA, 20 bp, mouse
ggacctgggtatggtgggtg

SEQ ID NO: 849824 - DNA, 20 bp, mouse
ggcccagtccagaatccggg

SEQ ID NO: 849825 - DNA, 20 bp, mouse
gcaaagaggggacctgggta

SEQ ID NO: 849826 - DNA, 20 bp, mouse
gagacattgtaaggagacaa

SEQ ID NO: 849827 - DNA, 20 bp, mouse
gcctctaaggcaggagaaca

SEQ ID NO: 849828 - DNA, 20 bp, mouse
gactgagtcattgtttcttg

SEQ ID NO: 849829 - DNA, 20 bp, mouse
gcagagatgaggagaatcag

SEQ ID NO: 849830 - DNA, 20 bp, mouse
gacctcacccagtgagtgtg

SEQ ID NO: 849831 - DNA, 20 bp, mouse
gtctctgggctaattatctg

SEQ ID NO: 849832 - DNA, 20 bp, mouse
gacccagtgagtgtggggct

SEQ ID NO: 849833 - DNA, 20 bp, mouse
gtaggcagagagacattgta

SEQ ID NO: 849834 - DNA, 20 bp, mouse
gtcctggcctgatgctcacc

SEQ ID NO: 849835 - DNA, 20 bp, mouse
gagagagggaacatccacag

SEQ ID NO: 849836 - DNA, 20 bp, mouse
ggaacctgcgctggcagagg

SEQ ID NO: 849837 - DNA, 20 bp, mouse
gggaagggaaccgccagcag

SEQ ID NO: 849838 - DNA, 20 bp, mouse
gtggtcagggcctctgctgg

SEQ ID NO: 849839 - DNA, 20 bp, mouse
gccttcagtggaaatccctt

SEQ ID NO: 849840 - DNA, 20 bp, mouse
gagaccccctctgccagcgc

SEQ ID NO: 849841 - DNA, 20 bp, mouse
gagttcttaagaaacttgat

SEQ ID NO: 849842 - DNA, 20 bp, mouse
gcagtgtttccccatatcct

SEQ ID NO: 849843 - DNA, 20 bp, mouse
gacagctctttggtctgtgg

SEQ ID NO: 849844 - DNA, 20 bp, mouse
gggtctttataagtaagtac

SEQ ID NO: 849845 - DNA, 20 bp, mouse
gctggggattaactagccaa

SEQ ID NO: 849846 - DNA, 20 bp, mouse
ggggtgtggggcatgaaggt

SEQ ID NO: 849847 - DNA, 20 bp, mouse
ggcatgaaggtgggcatatt

SEQ ID NO: 849848 - DNA, 20 bp, mouse
ggagaaggttgagaacggat

SEQ ID NO: 849849 - DNA, 20 bp, mouse
gtcctctggtatgcagagat

SEQ ID NO: 849850 - DNA, 20 bp, mouse
gcagactgtaaccatctcct

SEQ ID NO: 849851 - DNA, 20 bp, mouse
gggccaagccggagatatgt

SEQ ID NO: 849852 - DNA, 20 bp, mouse
gaggcaaggaagggatgagc

SEQ ID NO: 849853 - DNA, 20 bp, mouse
gcacattatacacaggtatg

SEQ ID NO: 849854 - DNA, 20 bp, mouse
gactgacggaaaggcatctt

SEQ ID NO: 849855 - DNA, 20 bp, mouse
gacggtgctgcggatggatc

SEQ ID NO: 849856 - DNA, 20 bp, mouse
gggctcctggcttctagcta

SEQ ID NO: 849857 - DNA, 20 bp, mouse
gccactcagttccttcaaat

SEQ ID NO: 849858 - DNA, 20 bp, mouse
gacacaggctgagacacatg

SEQ ID NO: 849859 - DNA, 20 bp, mouse
gagaaactggtacatctggg

SEQ ID NO: 849860 - DNA, 20 bp, mouse
ggtctatggccagtgcacat

SEQ ID NO: 849861 - DNA, 20 bp, mouse
gagcccagttttagagaaac

SEQ ID NO: 849862 - DNA, 20 bp, mouse
gtaaaaaggccatcttatct

SEQ ID NO: 849863 - DNA, 20 bp, mouse
gatggtggatggttggggca

SEQ ID NO: 849864 - DNA, 20 bp, mouse
gtgcttccacccagataaga

SEQ ID NO: 849865 - DNA, 20 bp, mouse
gattgccatgagactgtcta

SEQ ID NO: 849866 - DNA, 20 bp, mouse
gctaacccgaagcctgtcag

SEQ ID NO: 849867 - DNA, 20 bp, mouse
gtgctggcgcctctgtcccg

SEQ ID NO: 849868 - DNA, 20 bp, mouse
gcccccaccccgggtgcgta

SEQ ID NO: 849869 - DNA, 20 bp, mouse
gcctgggcgcaccacccgag

SEQ ID NO: 849870 - DNA, 20 bp, mouse
gtccctacgcacccggggtg

SEQ ID NO: 849871 - DNA, 20 bp, mouse
ggcgcccaggatataaatcc

SEQ ID NO: 849872 - DNA, 20 bp, mouse
gaggcctttaaccccttcca

SEQ ID NO: 849873 - DNA, 20 bp, mouse
gtagctcgctcccactcggg

SEQ ID NO: 849874 - DNA, 20 bp, mouse
ggggttagctcgctcccact

SEQ ID NO: 849875 - DNA, 20 bp, mouse
gcagcggtctctggcacggt

SEQ ID NO: 849876 - DNA, 20 bp, mouse
gaggacagatggcggcgaga

SEQ ID NO: 849877 - DNA, 20 bp, mouse
gcgcgacagcacatagtgat

SEQ ID NO: 849878 - DNA, 20 bp, mouse
gtgggtcgcagcaggaatgg

SEQ ID NO: 849879 - DNA, 20 bp, mouse
gtcgccaggaggacagatgg

SEQ ID NO: 849880 - DNA, 20 bp, mouse
gttaacgagccgagtctccc

SEQ ID NO: 849881 - DNA, 20 bp, mouse
gactcggctcgttaagtcgc

SEQ ID NO: 849882 - DNA, 20 bp, mouse
gacagcacatagtgattggc

SEQ ID NO: 849883 - DNA, 20 bp, mouse
gcctggaggcggggcggcga

SEQ ID NO: 849884 - DNA, 20 bp, mouse
gtgcagcgacttgctctctt

SEQ ID NO: 849885 - DNA, 20 bp, mouse
gtcagcgcggccccgggaaa

SEQ ID NO: 849886 - DNA, 20 bp, mouse
gcccgccccctcattctgat

SEQ ID NO: 849887 - DNA, 20 bp, mouse
ggttcgccggtgttgtaaaa

SEQ ID NO: 849888 - DNA, 20 bp, mouse
ggaaagtcttttcggggagg

SEQ ID NO: 849889 - DNA, 20 bp, mouse
gacacagcctatcagaatga

SEQ ID NO: 849890 - DNA, 20 bp, mouse
gtcttctggcatctgtacta

SEQ ID NO: 849891 - DNA, 20 bp, mouse
ggtcctgcccatgtatacat

SEQ ID NO: 849892 - DNA, 20 bp, mouse
gtagagagttcaaggttcgc

SEQ ID NO: 849893 - DNA, 20 bp, mouse
gccccgaaaagactttccat

SEQ ID NO: 849894 - DNA, 20 bp, mouse
ggtggtctcttacgagttca

SEQ ID NO: 849895 - DNA, 20 bp, mouse
gagtctcccttttacaacac

SEQ ID NO: 849896 - DNA, 20 bp, mouse
gcagcccaggggtgaaagat

SEQ ID NO: 849897 - DNA, 20 bp, mouse
gaagtgggaagacttcgcag

SEQ ID NO: 849898 - DNA, 20 bp, mouse
gacccctgggctgaggaagt

SEQ ID NO: 849899 - DNA, 20 bp, mouse
gacgtcccgcctggcgcgcc

SEQ ID NO: 849900 - DNA, 20 bp, mouse
gtccggccccaaggaagaaa

SEQ ID NO: 849901 - DNA, 20 bp, mouse
gcctggctgttgcctggaga

SEQ ID NO: 849902 - DNA, 20 bp, mouse
ggagacggggtgaaacagtc

SEQ ID NO: 849903 - DNA, 20 bp, mouse
gcggcggcgtcggaactcgc

SEQ ID NO: 849904 - DNA, 20 bp, mouse
gaagtcccggctggcgacgg

SEQ ID NO: 849905 - DNA, 20 bp, mouse
gtcccggctggcgacggcgg

SEQ ID NO: 849906 - DNA, 20 bp, mouse
gcggccccggagcccggcgt

SEQ ID NO: 849907 - DNA, 20 bp, mouse
gatcccgagcgcgggtgttg

SEQ ID NO: 849908 - DNA, 20 bp, mouse
gtcccggcctcgagctccag

SEQ ID NO: 849909 - DNA, 20 bp, mouse
gctccccaacacccgcgctc

SEQ ID NO: 849910 - DNA, 20 bp, mouse
ggcaaagcgcacttttcccg

SEQ ID NO: 849911 - DNA, 20 bp, mouse
gccgccgcccccagaagccg

SEQ ID NO: 849912 - DNA, 20 bp, mouse
gcccgctcccgctgctcgag

SEQ ID NO: 849913 - DNA, 20 bp, mouse
gagcgggagcgggaggcgag

SEQ ID NO: 849914 - DNA, 20 bp, mouse
ggtccgcgggcgacttgagg

SEQ ID NO: 849915 - DNA, 20 bp, mouse
ggccgcgcgcggcgattggg

SEQ ID NO: 849916 - DNA, 20 bp, mouse
gtcggcgctgagagcgaagg

SEQ ID NO: 849917 - DNA, 20 bp, mouse
gcgcgcgcccctcctctccg

SEQ ID NO: 849918 - DNA, 20 bp, mouse
gcaacccccgggcacactgg

SEQ ID NO: 849919 - DNA, 20 bp, mouse
gagctcggcgctgagagcga

SEQ ID NO: 849920 - DNA, 20 bp, mouse
gggaagaggctcgtcagccg

SEQ ID NO: 849921 - DNA, 20 bp, mouse
gcgtcagccgcggagaggag

SEQ ID NO: 849922 - DNA, 20 bp, mouse
gggaggggcgcgcgagagtc

SEQ ID NO: 849923 - DNA, 20 bp, mouse
gaccgcaggcgatgaggcag

SEQ ID NO: 849924 - DNA, 20 bp, mouse
gtcaccgcgtaccggtcatc

SEQ ID NO: 849925 - DNA, 20 bp, mouse
gccggggaaggagactgccc

SEQ ID NO: 849926 - DNA, 20 bp, mouse
ggtaagacgctcacagtcat

SEQ ID NO: 849927 - DNA, 20 bp, mouse
gaggtcaacagtggcgtcgg

SEQ ID NO: 849928 - DNA, 20 bp, mouse
gaggaggtcaacagtggcgt

SEQ ID NO: 849929 - DNA, 20 bp, mouse
gctgacgcgggaggcggaaa

SEQ ID NO: 849930 - DNA, 20 bp, mouse
gctagggcgcgtgttggcat

SEQ ID NO: 849931 - DNA, 20 bp, mouse
gaaaaagctttgtaggagga

SEQ ID NO: 849932 - DNA, 20 bp, mouse
gggctcaagctcctctcctc

SEQ ID NO: 849933 - DNA, 20 bp, mouse
ggccggccgctgaatcccca

SEQ ID NO: 849934 - DNA, 20 bp, mouse
gtatcccagacagtcctcgc

SEQ ID NO: 849935 - DNA, 20 bp, mouse
ggaaaccgccagcacccccg

SEQ ID NO: 849936 - DNA, 20 bp, mouse
gtagaggagcacactcgaga

SEQ ID NO: 849937 - DNA, 20 bp, mouse
ggctccgcagcgctccctag

SEQ ID NO: 849938 - DNA, 20 bp, mouse
gaaaaggcgagcactgagag

SEQ ID NO: 849939 - DNA, 20 bp, mouse
gcggccgcgtagaaagaggt

SEQ ID NO: 849940 - DNA, 20 bp, mouse
gactcgagagggaggaaccg

SEQ ID NO: 849941 - DNA, 20 bp, mouse
gccacagcgccagcagctag

SEQ ID NO: 849942 - DNA, 20 bp, mouse
ggcgaccgcctgcacaccac

SEQ ID NO: 849943 - DNA, 20 bp, mouse
ggtgcaggcggtcgccacta

SEQ ID NO: 849944 - DNA, 20 bp, mouse
gccgcccgaagagacacgtg

SEQ ID NO: 849945 - DNA, 20 bp, mouse
gggacgcagagacacgatgc

SEQ ID NO: 849946 - DNA, 20 bp, mouse
gcccgccggcctcggaagtc

SEQ ID NO: 849947 - DNA, 20 bp, mouse
gggcccgcgtcctcccccta

SEQ ID NO: 849948 - DNA, 20 bp, mouse
gagggcgcggcgagggcgaa

SEQ ID NO: 849949 - DNA, 20 bp, mouse
gggaagtcagggcgcggcga

SEQ ID NO: 849950 - DNA, 20 bp, mouse
ggcgaagggcgaagggccag

SEQ ID NO: 849951 - DNA, 20 bp, mouse
ggcgccctctgattcgggag

SEQ ID NO: 849952 - DNA, 20 bp, mouse
gtgcgcccaggagccggacc

SEQ ID NO: 849953 - DNA, 20 bp, mouse
gtcctgggcgcacgcaggtc

SEQ ID NO: 849954 - DNA, 20 bp, mouse
gcacgcaggtccggacccct

SEQ ID NO: 849955 - DNA, 20 bp, mouse
ggctccggtcccgccggcct

SEQ ID NO: 849956 - DNA, 20 bp, mouse
ggaggggaaaccccacatta

SEQ ID NO: 849957 - DNA, 20 bp, mouse
gaggccagggaacccctgca

SEQ ID NO: 849958 - DNA, 20 bp, mouse
ggaacacccaaaagaggcca

SEQ ID NO: 849959 - DNA, 20 bp, mouse
gaggagatggtcttttctat

SEQ ID NO: 849960 - DNA, 20 bp, mouse
gtctccttgcaggggttccc

SEQ ID NO: 849961 - DNA, 20 bp, mouse
ggcctcttttgggtgttcat

SEQ ID NO: 849962 - DNA, 20 bp, mouse
ggacaggagaaggtgctgtg

SEQ ID NO: 849963 - DNA, 20 bp, mouse
gaaagaccatctccttgcag

SEQ ID NO: 849964 - DNA, 20 bp, mouse
gagtaaagaggagataagac

SEQ ID NO: 849965 - DNA, 20 bp, mouse
ggatgctcaggagacatcta

SEQ ID NO: 849966 - DNA, 20 bp, mouse
ggagcgccaccatcttgaga

SEQ ID NO: 849967 - DNA, 20 bp, mouse
gaaaaggaggagggagccga

SEQ ID NO: 849968 - DNA, 20 bp, mouse
gcaaacgggacttccaactg

SEQ ID NO: 849969 - DNA, 20 bp, mouse
gcatcttgggactgcaactg

SEQ ID NO: 849970 - DNA, 20 bp, mouse
ggcaactggggccgcctgcg

SEQ ID NO: 849971 - DNA, 20 bp, mouse
gcctctaccggcgcacgtgg

SEQ ID NO: 849972 - DNA, 20 bp, mouse
ggaagtcccgtttgcatctt

SEQ ID NO: 849973 - DNA, 20 bp, mouse
ggctccgcccccacgtgcgc

SEQ ID NO: 849974 - DNA, 20 bp, mouse
gtctacctgcgcaattttaa

SEQ ID NO: 849975 - DNA, 20 bp, mouse
gaaggtcgcgagtccgcagt

SEQ ID NO: 849976 - DNA, 20 bp, mouse
gcacggggacgcggtccaga

SEQ ID NO: 849977 - DNA, 20 bp, mouse
gccagagggcggggtcgctc

SEQ ID NO: 849978 - DNA, 20 bp, mouse
ggggacgcggtccagagggc

SEQ ID NO: 849979 - DNA, 20 bp, mouse
gtgtgagccacggggacaat

SEQ ID NO: 849980 - DNA, 20 bp, mouse
gtgtccccgtggctcacact

SEQ ID NO: 849981 - DNA, 20 bp, mouse
gtcccggcagcgcttaagcc

SEQ ID NO: 849982 - DNA, 20 bp, mouse
ggcagccaggaccgcctcct

SEQ ID NO: 849983 - DNA, 20 bp, mouse
gacggggacaatggggccaa

SEQ ID NO: 849984 - DNA, 20 bp, mouse
gggtcgctctggcacccagg

SEQ ID NO: 849985 - DNA, 20 bp, mouse
gacactcgggactctgtacc

SEQ ID NO: 849986 - DNA, 20 bp, mouse
ggagtggggcggagctaaat

SEQ ID NO: 849987 - DNA, 20 bp, mouse
gttctctgaaggaggggcgg

SEQ ID NO: 849988 - DNA, 20 bp, mouse
gtaagggcggggtcttacga

SEQ ID NO: 849989 - DNA, 20 bp, mouse
gtaggtgcccgaagtggaga

SEQ ID NO: 849990 - DNA, 20 bp, mouse
ggctaagtgggaaatgtgta

SEQ ID NO: 849991 - DNA, 20 bp, mouse
gtgagtgggcggggtctgtc

SEQ ID NO: 849992 - DNA, 20 bp, mouse
gaggggcggtacttgaggca

SEQ ID NO: 849993 - DNA, 20 bp, mouse
ggacccagccgattctctga

SEQ ID NO: 849994 - DNA, 20 bp, mouse
gctaaatgggaatcgtgtaa

SEQ ID NO: 849995 - DNA, 20 bp, mouse
gggggcgggggtttggagtg

SEQ ID NO: 849996 - DNA, 20 bp, mouse
gcctgcgcgtggcggagagt

SEQ ID NO: 849997 - DNA, 20 bp, mouse
ggatgcctgcggcgaagagg

SEQ ID NO: 849998 - DNA, 20 bp, mouse
ggtcgactgcgcatgcataa

SEQ ID NO: 849999 - DNA, 20 bp, mouse
gtgggtgcgcctgcgcgtgg

SEQ ID NO: 850000 - DNA, 20 bp, mouse
gaaacacccgcggatgcctg

SEQ ID NO: 850001 - DNA, 20 bp, mouse
ggcgcgtggcggagagtggg

SEQ ID NO: 850002 - DNA, 20 bp, mouse
ggcacggcggcgttccgcgc

SEQ ID NO: 850003 - DNA, 20 bp, mouse
ggaacggcgagttacctcgt

SEQ ID NO: 850004 - DNA, 20 bp, mouse
gacgccgccgtgcgacgcga

SEQ ID NO: 850005 - DNA, 20 bp, mouse
gccaccctcgcgtcgcacgg

SEQ ID NO: 850006 - DNA, 20 bp, mouse
gcggggaggctggccaagct

SEQ ID NO: 850007 - DNA, 20 bp, mouse
gcgctctgacagctcttaaa

SEQ ID NO: 850008 - DNA, 20 bp, mouse
gtaggagggctcaggctctc

SEQ ID NO: 850009 - DNA, 20 bp, mouse
gaagagctgtcagagcgggg

SEQ ID NO: 850010 - DNA, 20 bp, mouse
gctggaggtagggaaggtag

SEQ ID NO: 850011 - DNA, 20 bp, mouse
ggaaagtcccagactccaca

SEQ ID NO: 850012 - DNA, 20 bp, mouse
ggggctcaggctctccggac

SEQ ID NO: 850013 - DNA, 20 bp, mouse
gcctgagccctcctagagcg

SEQ ID NO: 850014 - DNA, 20 bp, mouse
gaagggtgcgggctggaggt

SEQ ID NO: 850015 - DNA, 20 bp, mouse
gcattgtgaggactttgaga

SEQ ID NO: 850016 - DNA, 20 bp, mouse
ggggctctgaaggtggccta

SEQ ID NO: 850017 - DNA, 20 bp, mouse
gagagcctccctatcctcct

SEQ ID NO: 850018 - DNA, 20 bp, mouse
gtcctcctgggctctgaagg

SEQ ID NO: 850019 - DNA, 20 bp, mouse
gttcagagcccaggaggata

SEQ ID NO: 850020 - DNA, 20 bp, mouse
gagagcccaggaggataggg

SEQ ID NO: 850021 - DNA, 20 bp, mouse
gggaccagagcctggggcat

SEQ ID NO: 850022 - DNA, 20 bp, mouse
gtctccctgccagaaaccac

SEQ ID NO: 850023 - DNA, 20 bp, mouse
gcagtaggctcagtctgctt

SEQ ID NO: 850024 - DNA, 20 bp, mouse
gagtacagaaggtatctagt

SEQ ID NO: 850025 - DNA, 20 bp, mouse
gctgggtcacacccacctct

SEQ ID NO: 850026 - DNA, 20 bp, mouse
gtataggacgacatggggtg

SEQ ID NO: 850027 - DNA, 20 bp, mouse
gagtccctgtaggaaggtgt

SEQ ID NO: 850028 - DNA, 20 bp, mouse
gcacccaactcctggaagac

SEQ ID NO: 850029 - DNA, 20 bp, mouse
gactctgcgagagcaagtgg

SEQ ID NO: 850030 - DNA, 20 bp, mouse
gaactcctggaagacgggct

SEQ ID NO: 850031 - DNA, 20 bp, mouse
gacccctggggcaatggtaa

SEQ ID NO: 850032 - DNA, 20 bp, mouse
ggggccaacaccttcctaca

SEQ ID NO: 850033 - DNA, 20 bp, mouse
gagtggaggttgttctctga

SEQ ID NO: 850034 - DNA, 20 bp, mouse
ggtgagatgtgtcggagtat

SEQ ID NO: 850035 - DNA, 20 bp, mouse
gagagaaatcagagagacca

SEQ ID NO: 850036 - DNA, 20 bp, mouse
ggctcccaggagagtgaaaa

SEQ ID NO: 850037 - DNA, 20 bp, mouse
ggggagccaccgggagttta

SEQ ID NO: 850038 - DNA, 20 bp, mouse
gcggagcagagcacgctcgg

SEQ ID NO: 850039 - DNA, 20 bp, mouse
gtcgccctgggtgcgcccgg

SEQ ID NO: 850040 - DNA, 20 bp, mouse
gggagtgtggcggctgctag

SEQ ID NO: 850041 - DNA, 20 bp, mouse
ggcccctccgggcgcaccca

SEQ ID NO: 850042 - DNA, 20 bp, mouse
ggaggcgctcggcgctcatc

SEQ ID NO: 850043 - DNA, 20 bp, mouse
gcgaaatgctcttggcgcta

SEQ ID NO: 850044 - DNA, 20 bp, mouse
gtgtatatcctggagtgtgg

SEQ ID NO: 850045 - DNA, 20 bp, mouse
ggcctcgagcgaaatgctct

SEQ ID NO: 850046 - DNA, 20 bp, mouse
gccgccgcgccgccatgatg

SEQ ID NO: 850047 - DNA, 20 bp, mouse
gcccaaagtggcacaagggg

SEQ ID NO: 850048 - DNA, 20 bp, mouse
ggaccttagcgtctagggag

SEQ ID NO: 850049 - DNA, 20 bp, mouse
gcacccccaaagtggcacaa

SEQ ID NO: 850050 - DNA, 20 bp, mouse
gcctagacgctaaggtcctg

SEQ ID NO: 850051 - DNA, 20 bp, mouse
gcggcggggctgtcgcgctg

SEQ ID NO: 850052 - DNA, 20 bp, mouse
gagcccctccctagacgcta

SEQ ID NO: 850053 - DNA, 20 bp, mouse
gaggtcctgcggctccttta

SEQ ID NO: 850054 - DNA, 20 bp, mouse
gccgcgccgccatgatgagg

SEQ ID NO: 850055 - DNA, 20 bp, mouse
gggtggggtggggaatccaa

SEQ ID NO: 850056 - DNA, 20 bp, mouse
gagctgcaggccagacctga

SEQ ID NO: 850057 - DNA, 20 bp, mouse
gggccagggttgaggaagag

SEQ ID NO: 850058 - DNA, 20 bp, mouse
gaccctggcccgccagttca

SEQ ID NO: 850059 - DNA, 20 bp, mouse
gggagctgagatccctgaac

SEQ ID NO: 850060 - DNA, 20 bp, mouse
gcaacagctaacatcttgag

SEQ ID NO: 850061 - DNA, 20 bp, mouse
gtccctgaactggcgggcca

SEQ ID NO: 850062 - DNA, 20 bp, mouse
ggtggctggtgttgttaaat

SEQ ID NO: 850063 - DNA, 20 bp, mouse
ggcgggtagccagagctggc

SEQ ID NO: 850064 - DNA, 20 bp, mouse
gggctacccgccctcaggtc

SEQ ID NO: 850065 - DNA, 20 bp, mouse
ggctctggctacccgccctc

SEQ ID NO: 850066 - DNA, 20 bp, mouse
gagggcatcacggaagtagt

SEQ ID NO: 850067 - DNA, 20 bp, mouse
gagccccccgagcgcgatgt

SEQ ID NO: 850068 - DNA, 20 bp, mouse
gtagtaggcgcgttcctccc

SEQ ID NO: 850069 - DNA, 20 bp, mouse
ggccgagctcgaggcacgat

SEQ ID NO: 850070 - DNA, 20 bp, mouse
gaccgtgaaaggaacccggg

SEQ ID NO: 850071 - DNA, 20 bp, mouse
gcgcccacatcgcgctcggg

SEQ ID NO: 850072 - DNA, 20 bp, mouse
gtgggcggggccgccccggg

SEQ ID NO: 850073 - DNA, 20 bp, mouse
ggccccgcccacatcgcgct

SEQ ID NO: 850074 - DNA, 20 bp, mouse
gccacgatgacgctcccatc

SEQ ID NO: 850075 - DNA, 20 bp, mouse
gtcgcggtgaaaaccgtgaa

SEQ ID NO: 850076 - DNA, 20 bp, mouse
ggccatggggagcatcccgc

SEQ ID NO: 850077 - DNA, 20 bp, mouse
gggcctggaacccttgccgc

SEQ ID NO: 850078 - DNA, 20 bp, mouse
ggaagtggtccgctgaactg

SEQ ID NO: 850079 - DNA, 20 bp, mouse
gatggggagcatcccgcagg

SEQ ID NO: 850080 - DNA, 20 bp, mouse
gtccccatggcctccacctg

SEQ ID NO: 850081 - DNA, 20 bp, mouse
gccgaactagcgcgcgggga

SEQ ID NO: 850082 - DNA, 20 bp, mouse
ggccgcaggtggaggccatg

SEQ ID NO: 850083 - DNA, 20 bp, mouse
ggcagccaggtgggcgtgtc

SEQ ID NO: 850084 - DNA, 20 bp, mouse
gctgtggcctgccacctccg

SEQ ID NO: 850085 - DNA, 20 bp, mouse
gcgcgctccggtcttgggga

SEQ ID NO: 850086 - DNA, 20 bp, mouse
gtaaggaaaaaacaagtcac

SEQ ID NO: 850087 - DNA, 20 bp, mouse
gcatacaacagaaatcatta

SEQ ID NO: 850088 - DNA, 20 bp, mouse
gaaaagagctgtatgcaaag

SEQ ID NO: 850089 - DNA, 20 bp, mouse
gacttagcaactaagatagc

SEQ ID NO: 850090 - DNA, 20 bp, mouse
gcttgtctggcatcagctga

SEQ ID NO: 850091 - DNA, 20 bp, mouse
gtatctcttttccattcttc

SEQ ID NO: 850092 - DNA, 20 bp, mouse
ggcatacagctcttttttat

SEQ ID NO: 850093 - DNA, 20 bp, mouse
gaatgccaggacagtgaaat

SEQ ID NO: 850094 - DNA, 20 bp, mouse
ggaatagggggtttgcagaa

SEQ ID NO: 850095 - DNA, 20 bp, mouse
gacagtgaaatgggagtagg

SEQ ID NO: 850096 - DNA, 20 bp, mouse
gtaagcagcagtcgagatga

SEQ ID NO: 850097 - DNA, 20 bp, mouse
gctccacactgcaactcgcc

SEQ ID NO: 850098 - DNA, 20 bp, mouse
gtcgccaggctcacaagggg

SEQ ID NO: 850099 - DNA, 20 bp, mouse
gcgcggggcaggccagtcgg

SEQ ID NO: 850100 - DNA, 20 bp, mouse
gcaactcgccaggctcacaa

SEQ ID NO: 850101 - DNA, 20 bp, mouse
gagcctggcgagttgcagtg

SEQ ID NO: 850102 - DNA, 20 bp, mouse
gccggcaagagctgagtgag

SEQ ID NO: 850103 - DNA, 20 bp, mouse
gagggcaaacacatttgggg

SEQ ID NO: 850104 - DNA, 20 bp, mouse
ggggccaccccttgtgagcc

SEQ ID NO: 850105 - DNA, 20 bp, mouse
ggaccggtcctcacccccca

SEQ ID NO: 850106 - DNA, 20 bp, mouse
ggggaccagcatccgccagg

SEQ ID NO: 850107 - DNA, 20 bp, mouse
gggaggccatcccaagggga

SEQ ID NO: 850108 - DNA, 20 bp, mouse
ggggcgcggagacaatgcgc

SEQ ID NO: 850109 - DNA, 20 bp, mouse
ggcggatgctggtccccgac

SEQ ID NO: 850110 - DNA, 20 bp, mouse
gtgcgcgtccggagcccgtc

SEQ ID NO: 850111 - DNA, 20 bp, mouse
gagccccaccggcgcgtgtg

SEQ ID NO: 850112 - DNA, 20 bp, mouse
gcgcgtgggaggccatccca

SEQ ID NO: 850113 - DNA, 20 bp, mouse
gagtgcagacctggaggcgg

SEQ ID NO: 850114 - DNA, 20 bp, mouse
gccggacgcgcagaagagtg

SEQ ID NO: 850115 - DNA, 20 bp, mouse
gacgcgcagaagagtgaggc

SEQ ID NO: 850116 - DNA, 20 bp, mouse
ggggtccagggaatttccca

SEQ ID NO: 850117 - DNA, 20 bp, mouse
gaactcctggtgcctctaga

SEQ ID NO: 850118 - DNA, 20 bp, mouse
ggcaccaggagttgtcgcaa

SEQ ID NO: 850119 - DNA, 20 bp, mouse
gactggaggccgaagttctg

SEQ ID NO: 850120 - DNA, 20 bp, mouse
gcccccgggcaccgccctcg

SEQ ID NO: 850121 - DNA, 20 bp, mouse
ggggcccttgggaaattccc

SEQ ID NO: 850122 - DNA, 20 bp, mouse
ggggttgcgccccagaactt

SEQ ID NO: 850123 - DNA, 20 bp, mouse
gtgcgagcctgcgcttccga

SEQ ID NO: 850124 - DNA, 20 bp, mouse
gcctctagagggtaaggggg

SEQ ID NO: 850125 - DNA, 20 bp, mouse
gaaggaggtgcagcgggctg

SEQ ID NO: 850126 - DNA, 20 bp, mouse
ggggactgacaggaggtctt

SEQ ID NO: 850127 - DNA, 20 bp, mouse
gtaccagaaaaggggagcat

SEQ ID NO: 850128 - DNA, 20 bp, mouse
gtggccttggtcaaaagctc

SEQ ID NO: 850129 - DNA, 20 bp, mouse
gatctcaggggtctcctctc

SEQ ID NO: 850130 - DNA, 20 bp, mouse
gcggatgcctaccagaaaag

SEQ ID NO: 850131 - DNA, 20 bp, mouse
gctcccaaggggcaggcgta

SEQ ID NO: 850132 - DNA, 20 bp, mouse
gcgagcgtggagcatgcatt

SEQ ID NO: 850133 - DNA, 20 bp, mouse
gcaggcgtaaggctctgagg

SEQ ID NO: 850134 - DNA, 20 bp, mouse
gctggtgcgcacaggctcgt

SEQ ID NO: 850135 - DNA, 20 bp, mouse
gcccccgctatcctgaagtt

SEQ ID NO: 850136 - DNA, 20 bp, mouse
gcccgcgcgagccaccgggt

SEQ ID NO: 850137 - DNA, 20 bp, mouse
gccgccccgcgcgagccacc

SEQ ID NO: 850138 - DNA, 20 bp, mouse
ggcgccgaatccccacccgg

SEQ ID NO: 850139 - DNA, 20 bp, mouse
gagcgccgggcgggcgccgc

SEQ ID NO: 850140 - DNA, 20 bp, mouse
ggggtctgacctaaatgcgg

SEQ ID NO: 850141 - DNA, 20 bp, mouse
gcgcgggtccgaggcgtcat

SEQ ID NO: 850142 - DNA, 20 bp, mouse
ggagccaccgggtggggatt

SEQ ID NO: 850143 - DNA, 20 bp, mouse
gagagggtctgacctaaatg

SEQ ID NO: 850144 - DNA, 20 bp, mouse
gcggggtccccatgacgcct

SEQ ID NO: 850145 - DNA, 20 bp, mouse
ggcaaagtgtcccggagcgc

SEQ ID NO: 850146 - DNA, 20 bp, mouse
ggccgagggcgtgtcgccca

SEQ ID NO: 850147 - DNA, 20 bp, mouse
gtgtcgcccagggcagatca

SEQ ID NO: 850148 - DNA, 20 bp, mouse
gacagggtgaagcagatagg

SEQ ID NO: 850149 - DNA, 20 bp, mouse
ggggcggttcggggagagag

SEQ ID NO: 850150 - DNA, 20 bp, mouse
gggagacccagcagagagtc

SEQ ID NO: 850151 - DNA, 20 bp, mouse
gcctgacgccggcgggtctc

SEQ ID NO: 850152 - DNA, 20 bp, mouse
ggacccgccggcgtcaggct

SEQ ID NO: 850153 - DNA, 20 bp, mouse
gcacgccctcggccgcgcta

SEQ ID NO: 850154 - DNA, 20 bp, mouse
gggcgggtctcgggcggttc

SEQ ID NO: 850155 - DNA, 20 bp, mouse
gaatccgagcctgacgccgg

SEQ ID NO: 850156 - DNA, 20 bp, mouse
gggaaacttcagtgtctcat

SEQ ID NO: 850157 - DNA, 20 bp, mouse
gtctagttagacagtcacgg

SEQ ID NO: 850158 - DNA, 20 bp, mouse
gaccgcgcctggagtctgat

SEQ ID NO: 850159 - DNA, 20 bp, mouse
gagactccaggcgcggtcag

SEQ ID NO: 850160 - DNA, 20 bp, mouse
gtaacagtgggctctgcggg

SEQ ID NO: 850161 - DNA, 20 bp, mouse
gctctgcggggggcgctcct

SEQ ID NO: 850162 - DNA, 20 bp, mouse
ggagatgcgaggagaagcct

SEQ ID NO: 850163 - DNA, 20 bp, mouse
gaggtctagttagacagtca

SEQ ID NO: 850164 - DNA, 20 bp, mouse
ggaaaggtcgtgacactccc

SEQ ID NO: 850165 - DNA, 20 bp, mouse
gcaggcgcggtcaggggggg

SEQ ID NO: 850166 - DNA, 20 bp, mouse
gcccccgccgctcgcgtctg

SEQ ID NO: 850167 - DNA, 20 bp, mouse
gcgcctggaggggaacggaa

SEQ ID NO: 850168 - DNA, 20 bp, mouse
gaaaggacagggtgcgcggg

SEQ ID NO: 850169 - DNA, 20 bp, mouse
gctcgcagtgcttggggaat

SEQ ID NO: 850170 - DNA, 20 bp, mouse
ggagcccagcgagcgataaa

SEQ ID NO: 850171 - DNA, 20 bp, mouse
gagcgataaagggcagcccg

SEQ ID NO: 850172 - DNA, 20 bp, mouse
ggtgcttggggaattggctg

SEQ ID NO: 850173 - DNA, 20 bp, mouse
ggctatctccgggtgaggag

SEQ ID NO: 850174 - DNA, 20 bp, mouse
gccccaagcactgcgagcgc

SEQ ID NO: 850175 - DNA, 20 bp, mouse
gtccaggcgcagctaaagaa

SEQ ID NO: 850176 - DNA, 20 bp, mouse
ggtggcgccccgtagaacgg

SEQ ID NO: 850177 - DNA, 20 bp, mouse
ggcggtggcgccccgtagaa

SEQ ID NO: 850178 - DNA, 20 bp, mouse
ggaggcggccgccacaccta

SEQ ID NO: 850179 - DNA, 20 bp, mouse
gctccccggcgccctaggtg

SEQ ID NO: 850180 - DNA, 20 bp, mouse
gctgctctggccacccgcga

SEQ ID NO: 850181 - DNA, 20 bp, mouse
ggccccgtagaacggagggg

SEQ ID NO: 850182 - DNA, 20 bp, mouse
gtgaaggccgcgcgtgtccc

SEQ ID NO: 850183 - DNA, 20 bp, mouse
ggccgccacacctagggcgc

SEQ ID NO: 850184 - DNA, 20 bp, mouse
gggagcacccgggctggcgc

SEQ ID NO: 850185 - DNA, 20 bp, mouse
gtcctcccctccgttctacg

SEQ ID NO: 850186 - DNA, 20 bp, mouse
gcccgcccggcccacaactc

SEQ ID NO: 850187 - DNA, 20 bp, mouse
gcggcccacaactccggctc

SEQ ID NO: 850188 - DNA, 20 bp, mouse
gacaactccggctctgggaa

SEQ ID NO: 850189 - DNA, 20 bp, mouse
gagcagccaatcagcgcccg

SEQ ID NO: 850190 - DNA, 20 bp, mouse
gacaccctggaagcgacctg

SEQ ID NO: 850191 - DNA, 20 bp, mouse
gaatcagcgcccgcggccta

SEQ ID NO: 850192 - DNA, 20 bp, mouse
gtccacgcgagccaggttta

SEQ ID NO: 850193 - DNA, 20 bp, mouse
gccgggcgcacggaggcctc

SEQ ID NO: 850194 - DNA, 20 bp, mouse
gctctgggaagggcatctcc

SEQ ID NO: 850195 - DNA, 20 bp, mouse
gaggctttgcccaagtttgc

SEQ ID NO: 850196 - DNA, 20 bp, mouse
gggggcgggcggggccctgg

SEQ ID NO: 850197 - DNA, 20 bp, mouse
ggcgaggctccaaaccccca

SEQ ID NO: 850198 - DNA, 20 bp, mouse
ggggcggggcagcgccgcgg

SEQ ID NO: 850199 - DNA, 20 bp, mouse
gcgtgggtgcgcggggtgaa

SEQ ID NO: 850200 - DNA, 20 bp, mouse
ggtgtgtcggtgttcgtaga

SEQ ID NO: 850201 - DNA, 20 bp, mouse
gaaggtgtgtgcagagtgcg

SEQ ID NO: 850202 - DNA, 20 bp, mouse
gcgcacccacggccgcggga

SEQ ID NO: 850203 - DNA, 20 bp, mouse
gcgggtgtgcaccggtacac

SEQ ID NO: 850204 - DNA, 20 bp, mouse
gggcacagtgcggtcctgga

SEQ ID NO: 850205 - DNA, 20 bp, mouse
gggcgggccgaggccctggg

SEQ ID NO: 850206 - DNA, 20 bp, mouse
gaggagaagcccagtcccgc

SEQ ID NO: 850207 - DNA, 20 bp, mouse
gcctctagctcggcccaact

SEQ ID NO: 850208 - DNA, 20 bp, mouse
gtgggcgggtccagcggcgt

SEQ ID NO: 850209 - DNA, 20 bp, mouse
gtcaggaccgcccccgtggg

SEQ ID NO: 850210 - DNA, 20 bp, mouse
ggggctcaggaccgcccccg

SEQ ID NO: 850211 - DNA, 20 bp, mouse
gcgggccggggaggcccccc

SEQ ID NO: 850212 - DNA, 20 bp, mouse
ggacaaccccccccccacgg

SEQ ID NO: 850213 - DNA, 20 bp, mouse
ggccgaggatggggttacct

SEQ ID NO: 850214 - DNA, 20 bp, mouse
gcgggggcgggccgaggatg

SEQ ID NO: 850215 - DNA, 20 bp, mouse
ggggactgggcttctcctgg

SEQ ID NO: 850216 - DNA, 20 bp, mouse
gtcgggccacagttgagtag

SEQ ID NO: 850217 - DNA, 20 bp, mouse
gagaggaggagctgacaatc

SEQ ID NO: 850218 - DNA, 20 bp, mouse
gtggcccgaggcggggaagg

SEQ ID NO: 850219 - DNA, 20 bp, mouse
gtcgtggtgtgaatgaactg

SEQ ID NO: 850220 - DNA, 20 bp, mouse
gaatgaactgggggcatctt

SEQ ID NO: 850221 - DNA, 20 bp, mouse
ggccgaaacgtctgcttcca

SEQ ID NO: 850222 - DNA, 20 bp, mouse
gctcaactgtggcccgaggc

SEQ ID NO: 850223 - DNA, 20 bp, mouse
gtccctggaagcagacgttt

SEQ ID NO: 850224 - DNA, 20 bp, mouse
gctggagtctgcagaattcg

SEQ ID NO: 850225 - DNA, 20 bp, mouse
gcgctgatggacgttagaga

SEQ ID NO: 850226 - DNA, 20 bp, mouse
gggtccggatcggaaagttg

SEQ ID NO: 850227 - DNA, 20 bp, mouse
gtgagccaaggggtccggat

SEQ ID NO: 850228 - DNA, 20 bp, mouse
gcccaggcatctgtataacg

SEQ ID NO: 850229 - DNA, 20 bp, mouse
ggggacagggtgcctggagg

SEQ ID NO: 850230 - DNA, 20 bp, mouse
gtaaagctgtactacgggac

SEQ ID NO: 850231 - DNA, 20 bp, mouse
gacagttgagccaaggggtc

SEQ ID NO: 850232 - DNA, 20 bp, mouse
ggatggggagccttgaggag

SEQ ID NO: 850233 - DNA, 20 bp, mouse
gttgaggagggggcccaagg

SEQ ID NO: 850234 - DNA, 20 bp, mouse
ggatctaggtggtggctctc

SEQ ID NO: 850235 - DNA, 20 bp, mouse
ggggagcgtaccccgcctcc

SEQ ID NO: 850236 - DNA, 20 bp, mouse
gcgcgacgcccagctccgga

SEQ ID NO: 850237 - DNA, 20 bp, mouse
ggcgcggaaggcaggtgcgg

SEQ ID NO: 850238 - DNA, 20 bp, mouse
gcgggacagtgggcgcggag

SEQ ID NO: 850239 - DNA, 20 bp, mouse
gcactgtcccgcagactctg

SEQ ID NO: 850240 - DNA, 20 bp, mouse
gtcgcagctccggactccaa

SEQ ID NO: 850241 - DNA, 20 bp, mouse
ggcggaggggcgcggaaggc

SEQ ID NO: 850242 - DNA, 20 bp, mouse
gcggagctgcgaagcgaccc

SEQ ID NO: 850243 - DNA, 20 bp, mouse
gctcctccccggagccggac

SEQ ID NO: 850244 - DNA, 20 bp, mouse
ggcaggtgcgggggccggtc

SEQ ID NO: 850245 - DNA, 20 bp, mouse
gggaaggcaggtgcgggggc

SEQ ID NO: 850246 - DNA, 20 bp, mouse
ggcaggggacaaccccgcag

SEQ ID NO: 850247 - DNA, 20 bp, mouse
gcagcggagggcgggtgctg

SEQ ID NO: 850248 - DNA, 20 bp, mouse
gcggagggcgggtgctgggg

SEQ ID NO: 850249 - DNA, 20 bp, mouse
gcccgcagaggctaggagag

SEQ ID NO: 850250 - DNA, 20 bp, mouse
ggggagggagccgtgcgccc

SEQ ID NO: 850251 - DNA, 20 bp, mouse
gggagccgtgcgccccgggg

SEQ ID NO: 850252 - DNA, 20 bp, mouse
ggtcaggcggcgggactctt

SEQ ID NO: 850253 - DNA, 20 bp, mouse
gcgggatgaatagtcgagaa

SEQ ID NO: 850254 - DNA, 20 bp, mouse
ggccgcgcgctcacgggtgc

SEQ ID NO: 850255 - DNA, 20 bp, mouse
gggcggcgggactcttggga

SEQ ID NO: 850256 - DNA, 20 bp, mouse
gcccaagcgcccgcgggtcg

SEQ ID NO: 850257 - DNA, 20 bp, mouse
gtgcccaagggccatcctct

SEQ ID NO: 850258 - DNA, 20 bp, mouse
gtcaacctgcgagttagcga

SEQ ID NO: 850259 - DNA, 20 bp, mouse
gcagcccctcgcacagacga

SEQ ID NO: 850260 - DNA, 20 bp, mouse
gcgctcctccgagctcgcgg

SEQ ID NO: 850261 - DNA, 20 bp, mouse
gcccaccgccgcgagctcgg

SEQ ID NO: 850262 - DNA, 20 bp, mouse
gcgggggcgtggagcggagt

SEQ ID NO: 850263 - DNA, 20 bp, mouse
gctctgggtgtagaggatat

SEQ ID NO: 850264 - DNA, 20 bp, mouse
gtcaccctcgtctgtgcgag

SEQ ID NO: 850265 - DNA, 20 bp, mouse
ggagaccagcaggtgcccaa

SEQ ID NO: 850266 - DNA, 20 bp, mouse
gcgccctcccaggactgcgt

SEQ ID NO: 850267 - DNA, 20 bp, mouse
gcctgggagggcgatcggaa

SEQ ID NO: 850268 - DNA, 20 bp, mouse
gttcccacgcagtcctggga

SEQ ID NO: 850269 - DNA, 20 bp, mouse
gcccacgtaggtaacgtcta

SEQ ID NO: 850270 - DNA, 20 bp, mouse
gcgagcgcgccccaggtagg

SEQ ID NO: 850271 - DNA, 20 bp, mouse
gagagcgtgggacttgagac

SEQ ID NO: 850272 - DNA, 20 bp, mouse
ggcagtcctgggagggcgat

SEQ ID NO: 850273 - DNA, 20 bp, mouse
gagagagcgcgctgcgagcg

SEQ ID NO: 850274 - DNA, 20 bp, mouse
ggccctggaagcacccacgt

SEQ ID NO: 850275 - DNA, 20 bp, mouse
gcagagcgcaagcagagcgt

SEQ ID NO: 850276 - DNA, 20 bp, mouse
ggcaacttgggcaaaccctg

SEQ ID NO: 850277 - DNA, 20 bp, mouse
gataccctcgccacaacctt

SEQ ID NO: 850278 - DNA, 20 bp, mouse
ggaggaggcggatgtagggg

SEQ ID NO: 850279 - DNA, 20 bp, mouse
gggaggttgaccagagtgtg

SEQ ID NO: 850280 - DNA, 20 bp, mouse
gtcgccaaaggttgtggcga

SEQ ID NO: 850281 - DNA, 20 bp, mouse
gcgcggaggaggcggatgta

SEQ ID NO: 850282 - DNA, 20 bp, mouse
ggcggcgggtgccgccccca

SEQ ID NO: 850283 - DNA, 20 bp, mouse
gatcccggccaaggcaactt

SEQ ID NO: 850284 - DNA, 20 bp, mouse
gggcgagggtatcccggcca

SEQ ID NO: 850285 - DNA, 20 bp, mouse
ggtaggggcggcctgtccaa

SEQ ID NO: 850286 - DNA, 20 bp, mouse
gctaacggggatcaaagagg

SEQ ID NO: 850287 - DNA, 20 bp, mouse
gaagcaggtctcctaccctt

SEQ ID NO: 850288 - DNA, 20 bp, mouse
gagtcaatgtccctaagggt

SEQ ID NO: 850289 - DNA, 20 bp, mouse
ggacctaacggggatcaaag

SEQ ID NO: 850290 - DNA, 20 bp, mouse
gaggaaatcggggttagggt

SEQ ID NO: 850291 - DNA, 20 bp, mouse
gccttctctcccagactgag

SEQ ID NO: 850292 - DNA, 20 bp, mouse
gcaagaagtcaatgtcccta

SEQ ID NO: 850293 - DNA, 20 bp, mouse
ggagaggtgacctgagttca

SEQ ID NO: 850294 - DNA, 20 bp, mouse
ggggcccattgcttagaatt

SEQ ID NO: 850295 - DNA, 20 bp, mouse
gtggtctccttgaaggcttc

SEQ ID NO: 850296 - DNA, 20 bp, mouse
gagaaggggacgaggagaat

SEQ ID NO: 850297 - DNA, 20 bp, mouse
gcggacggacaaacgcagaa

SEQ ID NO: 850298 - DNA, 20 bp, mouse
gacaaacgcagaaggggacg

SEQ ID NO: 850299 - DNA, 20 bp, mouse
gtgtccgtccgggaggaccc

SEQ ID NO: 850300 - DNA, 20 bp, mouse
gccacgggccctctgatctg

SEQ ID NO: 850301 - DNA, 20 bp, mouse
gactccagggtcctcccgga

SEQ ID NO: 850302 - DNA, 20 bp, mouse
gcccaagagggatttagagg

SEQ ID NO: 850303 - DNA, 20 bp, mouse
gggagagcctggtccccaag

SEQ ID NO: 850304 - DNA, 20 bp, mouse
gcccccctctaaatccctct

SEQ ID NO: 850305 - DNA, 20 bp, mouse
gtgggaagggggtcgtttgt

SEQ ID NO: 850306 - DNA, 20 bp, mouse
gctggggcgcgctgtgggga

SEQ ID NO: 850307 - DNA, 20 bp, mouse
gcccggaggaggggtcacgc

SEQ ID NO: 850308 - DNA, 20 bp, mouse
ggggaaccccggtcgagtaa

SEQ ID NO: 850309 - DNA, 20 bp, mouse
gcgcgagccgagcagctcgg

SEQ ID NO: 850310 - DNA, 20 bp, mouse
gccgcccgcgccccggagga

SEQ ID NO: 850311 - DNA, 20 bp, mouse
gtgaggggatagtgactggg

SEQ ID NO: 850312 - DNA, 20 bp, mouse
gagagcagggttagaccccg

SEQ ID NO: 850313 - DNA, 20 bp, mouse
gccagaaggagcgatggggc

SEQ ID NO: 850314 - DNA, 20 bp, mouse
gaggacacaagtgcgagctc

SEQ ID NO: 850315 - DNA, 20 bp, mouse
gtggctccgttactcgaccg

SEQ ID NO: 850316 - DNA, 20 bp, mouse
gcccactccagcaaagaagg

SEQ ID NO: 850317 - DNA, 20 bp, mouse
ggcgcccactccagcaaaga

SEQ ID NO: 850318 - DNA, 20 bp, mouse
gcaaagaaggcggaccgtgt

SEQ ID NO: 850319 - DNA, 20 bp, mouse
gtatggggcgaggggctcgc

SEQ ID NO: 850320 - DNA, 20 bp, mouse
gtctcccgggagagatgctc

SEQ ID NO: 850321 - DNA, 20 bp, mouse
ggctgacccctcccacaaca

SEQ ID NO: 850322 - DNA, 20 bp, mouse
gactctgcccgccctgttgt

SEQ ID NO: 850323 - DNA, 20 bp, mouse
gagaaccccaatcctctcca

SEQ ID NO: 850324 - DNA, 20 bp, mouse
gggtgagcactcacctgaga

SEQ ID NO: 850325 - DNA, 20 bp, mouse
ggcccgccctgttgtgggag

SEQ ID NO: 850326 - DNA, 20 bp, mouse
gacccccaggggacggtagg

SEQ ID NO: 850327 - DNA, 20 bp, mouse
gttaaagcgcctatcctccc

SEQ ID NO: 850328 - DNA, 20 bp, mouse
gccgccttcccgctcggaat

SEQ ID NO: 850329 - DNA, 20 bp, mouse
gtccgagcgggaaggcggga

SEQ ID NO: 850330 - DNA, 20 bp, mouse
gatgcgccctctgcaggcca

SEQ ID NO: 850331 - DNA, 20 bp, mouse
gaggaattctccagcgcttg

SEQ ID NO: 850332 - DNA, 20 bp, mouse
gccttcccgctcggaatcgg

SEQ ID NO: 850333 - DNA, 20 bp, mouse
ggccccctaccgtcccctgg

SEQ ID NO: 850334 - DNA, 20 bp, mouse
gtcctcctccgattccgagc

SEQ ID NO: 850335 - DNA, 20 bp, mouse
gtcccgctcggaatcggagg

SEQ ID NO: 850336 - DNA, 20 bp, mouse
gtatgccccgggtaactttt

SEQ ID NO: 850337 - DNA, 20 bp, mouse
ggccgcgcggcattgtgggg

SEQ ID NO: 850338 - DNA, 20 bp, mouse
gctccctgcaaatcccgaaa

SEQ ID NO: 850339 - DNA, 20 bp, mouse
ggcagcggccggaagtacag

SEQ ID NO: 850340 - DNA, 20 bp, mouse
ggcggccggaagtacagggg

SEQ ID NO: 850341 - DNA, 20 bp, mouse
gccgagtttgagtcttaaag

SEQ ID NO: 850342 - DNA, 20 bp, mouse
gggagcctcaagcggccgcg

SEQ ID NO: 850343 - DNA, 20 bp, mouse
ggagatccgctatagcgcaa

SEQ ID NO: 850344 - DNA, 20 bp, mouse
gctgcaaatcccgaaacgga

SEQ ID NO: 850345 - DNA, 20 bp, mouse
ggaagcgagcagcagccaat

SEQ ID NO: 850346 - DNA, 20 bp, mouse
gcgccggcgcgccacggcta

SEQ ID NO: 850347 - DNA, 20 bp, mouse
gggaaggcgaaaggcgaaaa

SEQ ID NO: 850348 - DNA, 20 bp, mouse
gacggctagggctacacgtc

SEQ ID NO: 850349 - DNA, 20 bp, mouse
gagccctagccgtggcgcgc

SEQ ID NO: 850350 - DNA, 20 bp, mouse
gagggctacacgtcgggccg

SEQ ID NO: 850351 - DNA, 20 bp, mouse
gcacgctacacctcctctag

SEQ ID NO: 850352 - DNA, 20 bp, mouse
gggtgctgccatagcggaac

SEQ ID NO: 850353 - DNA, 20 bp, mouse
gtcgtcaactgcgcctgcgc

SEQ ID NO: 850354 - DNA, 20 bp, mouse
gccatgctgccccctagagg

SEQ ID NO: 850355 - DNA, 20 bp, mouse
gcgggaggctaaacaggttt

SEQ ID NO: 850356 - DNA, 20 bp, mouse
ggcctccgggcgcgccctga

SEQ ID NO: 850357 - DNA, 20 bp, mouse
gagagagccggcaggagagg

SEQ ID NO: 850358 - DNA, 20 bp, mouse
gcgcaggtgcgggtgagtcg

SEQ ID NO: 850359 - DNA, 20 bp, mouse
gcagacagcgcgcggggacc

SEQ ID NO: 850360 - DNA, 20 bp, mouse
gcggggtggctgcggtgggt

SEQ ID NO: 850361 - DNA, 20 bp, mouse
ggtagtctcaacgcaggtgc

SEQ ID NO: 850362 - DNA, 20 bp, mouse
gggaaatgtagtctcaacgc

SEQ ID NO: 850363 - DNA, 20 bp, mouse
ggggactcgggctctgcctc

SEQ ID NO: 850364 - DNA, 20 bp, mouse
gaggcggggagctgcctgag

SEQ ID NO: 850365 - DNA, 20 bp, mouse
gcgcgggcggagtgcaggga

SEQ ID NO: 850366 - DNA, 20 bp, mouse
gccacagaaaggctcttccc

SEQ ID NO: 850367 - DNA, 20 bp, mouse
ggggaccgaagaagacgaga

SEQ ID NO: 850368 - DNA, 20 bp, mouse
gacgagagggcctgttgtga

SEQ ID NO: 850369 - DNA, 20 bp, mouse
ggggaagtgtagtccaaagc

SEQ ID NO: 850370 - DNA, 20 bp, mouse
gacgcctcgcgagtcgtgtc

SEQ ID NO: 850371 - DNA, 20 bp, mouse
gtctgtggcgctgcttggat

SEQ ID NO: 850372 - DNA, 20 bp, mouse
gactagaaatgctgtcatca

SEQ ID NO: 850373 - DNA, 20 bp, mouse
gactcgaaggcggttgtttc

SEQ ID NO: 850374 - DNA, 20 bp, mouse
ggccgagggcgagttgacgc

SEQ ID NO: 850375 - DNA, 20 bp, mouse
gagaaattgccggcggcgat

SEQ ID NO: 850376 - DNA, 20 bp, mouse
gcccgcaggtcgcgctttga

SEQ ID NO: 850377 - DNA, 20 bp, mouse
gaggccccgcccctcgacgc

SEQ ID NO: 850378 - DNA, 20 bp, mouse
gcgggcattttcgaagtcga

SEQ ID NO: 850379 - DNA, 20 bp, mouse
gctcgacgcaggggacgtga

SEQ ID NO: 850380 - DNA, 20 bp, mouse
gcacgtgaccgaaccggaaa

SEQ ID NO: 850381 - DNA, 20 bp, mouse
gcgcaggggacgtgatggtc

SEQ ID NO: 850382 - DNA, 20 bp, mouse
gggaagaagggcagattctg

SEQ ID NO: 850383 - DNA, 20 bp, mouse
gacgtgcattatataatccc

SEQ ID NO: 850384 - DNA, 20 bp, mouse
ggccagagacgtagctaaaa

SEQ ID NO: 850385 - DNA, 20 bp, mouse
ggtcgaaggctcattgccaa

SEQ ID NO: 850386 - DNA, 20 bp, mouse
ggcgggacgcggagcttcga

SEQ ID NO: 850387 - DNA, 20 bp, mouse
ggctcgcaggggaaacgctg

SEQ ID NO: 850388 - DNA, 20 bp, mouse
ggagctgtggggacggaggc

SEQ ID NO: 850389 - DNA, 20 bp, mouse
gcggaggaagcggggctaag

SEQ ID NO: 850390 - DNA, 20 bp, mouse
gctaaggggacccgaggtgg

SEQ ID NO: 850391 - DNA, 20 bp, mouse
gcccgccggccgccatgtga

SEQ ID NO: 850392 - DNA, 20 bp, mouse
gggacgccgagctgtgggga

SEQ ID NO: 850393 - DNA, 20 bp, mouse
ggggagccccgggcaggatg

SEQ ID NO: 850394 - DNA, 20 bp, mouse
gacgcggagcccggaggaag

SEQ ID NO: 850395 - DNA, 20 bp, mouse
ggtgtcgtggagaaacctaa

SEQ ID NO: 850396 - DNA, 20 bp, mouse
gtagctctgagtcacacaat

SEQ ID NO: 850397 - DNA, 20 bp, mouse
ggtccctggggatacaagaa

SEQ ID NO: 850398 - DNA, 20 bp, mouse
gtccccaatgaatgctctta

SEQ ID NO: 850399 - DNA, 20 bp, mouse
gaccttaagagcattcattg

SEQ ID NO: 850400 - DNA, 20 bp, mouse
gcaccctggaatgtagcctg

SEQ ID NO: 850401 - DNA, 20 bp, mouse
gttccagggtggttactcag

SEQ ID NO: 850402 - DNA, 20 bp, mouse
ggggcagtaacggtagccac

SEQ ID NO: 850403 - DNA, 20 bp, mouse
ggagggatctgggcgtgaga

SEQ ID NO: 850404 - DNA, 20 bp, mouse
gtgccgctgagtaaccaccc

SEQ ID NO: 850405 - DNA, 20 bp, mouse
gagccacaggctacattcca

SEQ ID NO: 850406 - DNA, 20 bp, mouse
gccaagctgcgacccttcct

SEQ ID NO: 850407 - DNA, 20 bp, mouse
gtcgcagcttggcttcgtgg

SEQ ID NO: 850408 - DNA, 20 bp, mouse
gcgagacaacgcacataccg

SEQ ID NO: 850409 - DNA, 20 bp, mouse
gccggctaggctgcagtggt

SEQ ID NO: 850410 - DNA, 20 bp, mouse
ggagtagtgcgtgtcacccg

SEQ ID NO: 850411 - DNA, 20 bp, mouse
gcgagtgagcatgtgcagac

SEQ ID NO: 850412 - DNA, 20 bp, mouse
gttcgtggcgggaggtatgt

SEQ ID NO: 850413 - DNA, 20 bp, mouse
ggacagcggccggcctccgc

SEQ ID NO: 850414 - DNA, 20 bp, mouse
gggtcaacgtcttgtcttgg

SEQ ID NO: 850415 - DNA, 20 bp, mouse
gcaacgtcttgtcttggcgg

SEQ ID NO: 850416 - DNA, 20 bp, mouse
gtccactgagggtccctgaa

SEQ ID NO: 850417 - DNA, 20 bp, mouse
gtggctccggttaggtccaa

SEQ ID NO: 850418 - DNA, 20 bp, mouse
gccctcagtggaagtcatcc

SEQ ID NO: 850419 - DNA, 20 bp, mouse
gcctggcttgagcgtggtgc

SEQ ID NO: 850420 - DNA, 20 bp, mouse
gagtggaacacaggggcttc

SEQ ID NO: 850421 - DNA, 20 bp, mouse
gccggcgcctggcttgagcg

SEQ ID NO: 850422 - DNA, 20 bp, mouse
gcagacaagagtggaacaca

SEQ ID NO: 850423 - DNA, 20 bp, mouse
gtgcagatctagcttggctc

SEQ ID NO: 850424 - DNA, 20 bp, mouse
ggctgcttggagacttggcc

SEQ ID NO: 850425 - DNA, 20 bp, mouse
gacttggccaggagcccgcc

SEQ ID NO: 850426 - DNA, 20 bp, mouse
gccagctgagagcacgtggc

SEQ ID NO: 850427 - DNA, 20 bp, mouse
gtactagcaccgggggtgtg

SEQ ID NO: 850428 - DNA, 20 bp, mouse
gacccccggtgctagtaacc

SEQ ID NO: 850429 - DNA, 20 bp, mouse
gtcggagacaccctcctctc

SEQ ID NO: 850430 - DNA, 20 bp, mouse
gcactcgggaaggccagcta

SEQ ID NO: 850431 - DNA, 20 bp, mouse
gaggccagctagggtagcag

SEQ ID NO: 850432 - DNA, 20 bp, mouse
gcaaagcgcgctgctcgtcc

SEQ ID NO: 850433 - DNA, 20 bp, mouse
gtcccggttactagcaccgg

SEQ ID NO: 850434 - DNA, 20 bp, mouse
gaaggcgcctacactcggga

SEQ ID NO: 850435 - DNA, 20 bp, mouse
gcgggcccgccccacacccc

SEQ ID NO: 850436 - DNA, 20 bp, mouse
ggtcacccgcgaggcatctc

SEQ ID NO: 850437 - DNA, 20 bp, mouse
gaggtcggaggtcacccgcg

SEQ ID NO: 850438 - DNA, 20 bp, mouse
gtgccggaacggggagacag

SEQ ID NO: 850439 - DNA, 20 bp, mouse
gtggccccgccgagcttgtc

SEQ ID NO: 850440 - DNA, 20 bp, mouse
ggcggccccaagaacggcga

SEQ ID NO: 850441 - DNA, 20 bp, mouse
gtcgtcccgagatgcctcgc

SEQ ID NO: 850442 - DNA, 20 bp, mouse
gtgagcttgcagagccccga

SEQ ID NO: 850443 - DNA, 20 bp, mouse
gaggcgcgtctcgggtgagt

SEQ ID NO: 850444 - DNA, 20 bp, mouse
gaagggcgggcccgcgaggt

SEQ ID NO: 850445 - DNA, 20 bp, mouse
ggggtgacctccgacctcgc

SEQ ID NO: 850446 - DNA, 20 bp, mouse
ggcggcctctggaatgtggg

SEQ ID NO: 850447 - DNA, 20 bp, mouse
gcctgcgcgcggtctcgaag

SEQ ID NO: 850448 - DNA, 20 bp, mouse
ggcccccccccacattccag

SEQ ID NO: 850449 - DNA, 20 bp, mouse
ggtgccctgaggcctcgggg

SEQ ID NO: 850450 - DNA, 20 bp, mouse
gcccgtcaggaatgtgagga

SEQ ID NO: 850451 - DNA, 20 bp, mouse
gagtctgcgcacccctcggc

SEQ ID NO: 850452 - DNA, 20 bp, mouse
gcgcagcggcctctggaatg

SEQ ID NO: 850453 - DNA, 20 bp, mouse
gggaatgtgccctgaggcct

SEQ ID NO: 850454 - DNA, 20 bp, mouse
gtcggggtggaccagagcct

SEQ ID NO: 850455 - DNA, 20 bp, mouse
gacggccccgcgcgagagtg

SEQ ID NO: 850456 - DNA, 20 bp, mouse
gccgagacgcgccccctcgt

SEQ ID NO: 850457 - DNA, 20 bp, mouse
gtagcctcctggggcagaac

SEQ ID NO: 850458 - DNA, 20 bp, mouse
ggccaagagcccggacactc

SEQ ID NO: 850459 - DNA, 20 bp, mouse
gctcctggggcagaacgggg

SEQ ID NO: 850460 - DNA, 20 bp, mouse
gaacggggtggtcggcgatt

SEQ ID NO: 850461 - DNA, 20 bp, mouse
gaacacggggagaactgaat

SEQ ID NO: 850462 - DNA, 20 bp, mouse
gcccgcgcccagcgcggcga

SEQ ID NO: 850463 - DNA, 20 bp, mouse
ggggaagggacgagagatcc

SEQ ID NO: 850464 - DNA, 20 bp, mouse
gtggggcagaacggggtggt

SEQ ID NO: 850465 - DNA, 20 bp, mouse
ggattgggactgtcccacga

SEQ ID NO: 850466 - DNA, 20 bp, mouse
gcagctgcagggttaagctc

SEQ ID NO: 850467 - DNA, 20 bp, mouse
ggccccggccgacgccgtct

SEQ ID NO: 850468 - DNA, 20 bp, mouse
gccgccgggccgttgctccg

SEQ ID NO: 850469 - DNA, 20 bp, mouse
ggggaagctccgcggagcaa

SEQ ID NO: 850470 - DNA, 20 bp, mouse
ggccgtctgggctcggatcc

SEQ ID NO: 850471 - DNA, 20 bp, mouse
ggctccgcggagcaacggcc

SEQ ID NO: 850472 - DNA, 20 bp, mouse
ggggagcgacgaggccaggt

SEQ ID NO: 850473 - DNA, 20 bp, mouse
ggtgggaggcggtagggcgg

SEQ ID NO: 850474 - DNA, 20 bp, mouse
gatccgagcccagacggcgt

SEQ ID NO: 850475 - DNA, 20 bp, mouse
ggcaacggcccggcggcgac

SEQ ID NO: 850476 - DNA, 20 bp, mouse
gaagagatggaacggccgtg

SEQ ID NO: 850477 - DNA, 20 bp, mouse
gagcctgagaagagcacggg

SEQ ID NO: 850478 - DNA, 20 bp, mouse
gtgctcgcccagccggtccg

SEQ ID NO: 850479 - DNA, 20 bp, mouse
gcggagcctgagaagagcac

SEQ ID NO: 850480 - DNA, 20 bp, mouse
gggagggaacgcggaagaga

SEQ ID NO: 850481 - DNA, 20 bp, mouse
gtcactgctgggactcattc

SEQ ID NO: 850482 - DNA, 20 bp, mouse
gtccctcccgtgctcttctc

SEQ ID NO: 850483 - DNA, 20 bp, mouse
gcagctactggcgggaaagg

SEQ ID NO: 850484 - DNA, 20 bp, mouse
gcaactggactataaagggg

SEQ ID NO: 850485 - DNA, 20 bp, mouse
gctactggcgggaaaggggg

SEQ ID NO: 850486 - DNA, 20 bp, mouse
ggctcgctgcgcatgctcga

SEQ ID NO: 850487 - DNA, 20 bp, mouse
gcagaggctcagagcggccc

SEQ ID NO: 850488 - DNA, 20 bp, mouse
gggcagctggattcccggtc

SEQ ID NO: 850489 - DNA, 20 bp, mouse
gaggctcagagcggccccgg

SEQ ID NO: 850490 - DNA, 20 bp, mouse
gcgcgcgcccagcccgccta

SEQ ID NO: 850491 - DNA, 20 bp, mouse
gtgagcctctggtccagacc

SEQ ID NO: 850492 - DNA, 20 bp, mouse
ggaggcacgccaaccaataa

SEQ ID NO: 850493 - DNA, 20 bp, mouse
gcctggaagacccggaggag

SEQ ID NO: 850494 - DNA, 20 bp, mouse
ggaccgcctggaagacccgg

SEQ ID NO: 850495 - DNA, 20 bp, mouse
gggggaggcgcgcccgtgcg

SEQ ID NO: 850496 - DNA, 20 bp, mouse
gcgggtgatccttgcaatcc

SEQ ID NO: 850497 - DNA, 20 bp, mouse
gtggccggggcgcgcaggtg

SEQ ID NO: 850498 - DNA, 20 bp, mouse
gggaccacctaggacccggg

SEQ ID NO: 850499 - DNA, 20 bp, mouse
gcactcgggccgggtcacgt

SEQ ID NO: 850500 - DNA, 20 bp, mouse
gtgcggaccacctaggaccc

SEQ ID NO: 850501 - DNA, 20 bp, mouse
gcgagcgtttgacccgctca

SEQ ID NO: 850502 - DNA, 20 bp, mouse
gcgtgcgcggtcacctgacc

SEQ ID NO: 850503 - DNA, 20 bp, mouse
gtgacactcaagtttggagg

SEQ ID NO: 850504 - DNA, 20 bp, mouse
ggccccggccagcctcttcc

SEQ ID NO: 850505 - DNA, 20 bp, mouse
gttcccgccatggtacaggt

SEQ ID NO: 850506 - DNA, 20 bp, mouse
gaatgcagataggcgctcgg

SEQ ID NO: 850507 - DNA, 20 bp, mouse
gccgccagccgggctagggt

SEQ ID NO: 850508 - DNA, 20 bp, mouse
ggcgtggggcaggctggctc

SEQ ID NO: 850509 - DNA, 20 bp, mouse
gtgcgccccggtccgacctc

SEQ ID NO: 850510 - DNA, 20 bp, mouse
gtgatcccgccccaagtcag

SEQ ID NO: 850511 - DNA, 20 bp, mouse
gtcggcgggagaggtcggag

SEQ ID NO: 850512 - DNA, 20 bp, mouse
ggatctgccagaggtcggac

SEQ ID NO: 850513 - DNA, 20 bp, mouse
gtcctcctcccaccctagcc

SEQ ID NO: 850514 - DNA, 20 bp, mouse
ggggcaggctggctccggcc

SEQ ID NO: 850515 - DNA, 20 bp, mouse
ggataggcgctcggcgggag

SEQ ID NO: 850516 - DNA, 20 bp, mouse
gaccggaagcaaaggggcgc

SEQ ID NO: 850517 - DNA, 20 bp, mouse
gggccaatacggaagcggag

SEQ ID NO: 850518 - DNA, 20 bp, mouse
gccaagggccaatacggaag

SEQ ID NO: 850519 - DNA, 20 bp, mouse
ggcggagtggtcaggaaccc

SEQ ID NO: 850520 - DNA, 20 bp, mouse
gtaaaaccgaagagcgagat

SEQ ID NO: 850521 - DNA, 20 bp, mouse
ggaagtgaccggaagcaaag

SEQ ID NO: 850522 - DNA, 20 bp, mouse
ggaaggagcactagatgtgg

SEQ ID NO: 850523 - DNA, 20 bp, mouse
gggtctgtgacgtcatcttc

SEQ ID NO: 850524 - DNA, 20 bp, mouse
gcctcattggtgctgcccaa

SEQ ID NO: 850525 - DNA, 20 bp, mouse
gtccggcgcccctttgcttc

SEQ ID NO: 850526 - DNA, 20 bp, mouse
gaggacaaggggcatgacag

SEQ ID NO: 850527 - DNA, 20 bp, mouse
gagaggctgcacaggacaag

SEQ ID NO: 850528 - DNA, 20 bp, mouse
gcagctaacgcccaccctgg

SEQ ID NO: 850529 - DNA, 20 bp, mouse
gaccgtgactgtgacctcca

SEQ ID NO: 850530 - DNA, 20 bp, mouse
gaacagtaggagtcagtcac

SEQ ID NO: 850531 - DNA, 20 bp, mouse
gcagtcacaggttgagaagt

SEQ ID NO: 850532 - DNA, 20 bp, mouse
gttagctgtcgggtttcctc

SEQ ID NO: 850533 - DNA, 20 bp, mouse
gacaggttgagaagtgggca

SEQ ID NO: 850534 - DNA, 20 bp, mouse
ggaaggccattctgcagcat

SEQ ID NO: 850535 - DNA, 20 bp, mouse
gcgacagctaacgcccaccc

SEQ ID NO: 850536 - DNA, 20 bp, mouse
ggggcgggctcaactcgggc

SEQ ID NO: 850537 - DNA, 20 bp, mouse
gcccgcgcgtcacggagcac

SEQ ID NO: 850538 - DNA, 20 bp, mouse
gccaccgtccatccacccta

SEQ ID NO: 850539 - DNA, 20 bp, mouse
gccgggggcgggctcaactc

SEQ ID NO: 850540 - DNA, 20 bp, mouse
gaacagctgtgcagccacgc

SEQ ID NO: 850541 - DNA, 20 bp, mouse
ggcggggtgagtgtccagcg

SEQ ID NO: 850542 - DNA, 20 bp, mouse
ggacggccacgaccctagaa

SEQ ID NO: 850543 - DNA, 20 bp, mouse
ggacgtctgccgaagatcct

SEQ ID NO: 850544 - DNA, 20 bp, mouse
gtggcaatcctcagccgggg

SEQ ID NO: 850545 - DNA, 20 bp, mouse
gagcccgcccccgggactac

SEQ ID NO: 850546 - DNA, 20 bp, mouse
gtgcgaggggctttcggggt

SEQ ID NO: 850547 - DNA, 20 bp, mouse
gtctcatgttggtgtgaaca

SEQ ID NO: 850548 - DNA, 20 bp, mouse
gtggccctgcctgactccac

SEQ ID NO: 850549 - DNA, 20 bp, mouse
gaggccacaaggtctcatgt

SEQ ID NO: 850550 - DNA, 20 bp, mouse
gctgaagccagtccgtgtca

SEQ ID NO: 850551 - DNA, 20 bp, mouse
ggaagtgtgctgaccattga

SEQ ID NO: 850552 - DNA, 20 bp, mouse
gcgaaagcccctcgcaaccc

SEQ ID NO: 850553 - DNA, 20 bp, mouse
gtaactgggcaaaggaaatg

SEQ ID NO: 850554 - DNA, 20 bp, mouse
gcagtgtgataactgggcaa

SEQ ID NO: 850555 - DNA, 20 bp, mouse
gcacacttcctgggttgcga

SEQ ID NO: 850556 - DNA, 20 bp, mouse
gtcaacaagacacgtgactc

SEQ ID NO: 850557 - DNA, 20 bp, mouse
gaagacacgtgactctggcc

SEQ ID NO: 850558 - DNA, 20 bp, mouse
gacactgtttagctatggat

SEQ ID NO: 850559 - DNA, 20 bp, mouse
gctaaaacactgtttagcta

SEQ ID NO: 850560 - DNA, 20 bp, mouse
gctatggattgggggtcttt

SEQ ID NO: 850561 - DNA, 20 bp, mouse
gcatatcgaaaccaaacata

SEQ ID NO: 850562 - DNA, 20 bp, mouse
gggccatattgtcacatcaa

SEQ ID NO: 850563 - DNA, 20 bp, mouse
gctgtttagctatggattgg

SEQ ID NO: 850564 - DNA, 20 bp, mouse
gtgcaaaatgagaccagatg

SEQ ID NO: 850565 - DNA, 20 bp, mouse
gaggttctattaaattgtct

SEQ ID NO: 850566 - DNA, 20 bp, mouse
gcagagtaggatctgtggat

SEQ ID NO: 850567 - DNA, 20 bp, mouse
gaaagtgcagccgtagatta

SEQ ID NO: 850568 - DNA, 20 bp, mouse
ggatgaagcaggtttcacaa

SEQ ID NO: 850569 - DNA, 20 bp, mouse
gagggcctggcagaatgtga

SEQ ID NO: 850570 - DNA, 20 bp, mouse
gataccaggaagagcaggga

SEQ ID NO: 850571 - DNA, 20 bp, mouse
gtcatctggtgccaagatgc

SEQ ID NO: 850572 - DNA, 20 bp, mouse
ggagagtgaatcagcctcag

SEQ ID NO: 850573 - DNA, 20 bp, mouse
gccagtggcgagcctgtgtc

SEQ ID NO: 850574 - DNA, 20 bp, mouse
gaggctgtagtcaaaggtca

SEQ ID NO: 850575 - DNA, 20 bp, mouse
ggatctgtggattggctgtc

SEQ ID NO: 850576 - DNA, 20 bp, mouse
gcgggcgcgacgctaatcga

SEQ ID NO: 850577 - DNA, 20 bp, mouse
gctagcccaggcggaaggga

SEQ ID NO: 850578 - DNA, 20 bp, mouse
ggcgggcgacgggttcccga

SEQ ID NO: 850579 - DNA, 20 bp, mouse
gagagctagcccaggcggaa

SEQ ID NO: 850580 - DNA, 20 bp, mouse
gctagaaggaatgacgagac

SEQ ID NO: 850581 - DNA, 20 bp, mouse
gtcgcccgcggcgcttagtt

SEQ ID NO: 850582 - DNA, 20 bp, mouse
ggaggaaatgcttgagtcgg

SEQ ID NO: 850583 - DNA, 20 bp, mouse
gtaggcagagctagcccagg

SEQ ID NO: 850584 - DNA, 20 bp, mouse
gcgggccccggcctaggaga

SEQ ID NO: 850585 - DNA, 20 bp, mouse
ggtgaggagtaggggaatac

SEQ ID NO: 850586 - DNA, 20 bp, mouse
gtcaacccaagtctgcccgg

SEQ ID NO: 850587 - DNA, 20 bp, mouse
gtctgcccggaggactgggg

SEQ ID NO: 850588 - DNA, 20 bp, mouse
gtcacccaccccagtcctcc

SEQ ID NO: 850589 - DNA, 20 bp, mouse
gcagtcctccgggcagactt

SEQ ID NO: 850590 - DNA, 20 bp, mouse
gaattcctctgggctaggga

SEQ ID NO: 850591 - DNA, 20 bp, mouse
gttacaattcctctgggcta

SEQ ID NO: 850592 - DNA, 20 bp, mouse
gaagtggtccggttattttt

SEQ ID NO: 850593 - DNA, 20 bp, mouse
gtatctggccggctaggggt

SEQ ID NO: 850594 - DNA, 20 bp, mouse
gtgtaactgattccccagga

SEQ ID NO: 850595 - DNA, 20 bp, mouse
gaatcagttacaattcctct

SEQ ID NO: 850596 - DNA, 20 bp, mouse
gcaacctagcacctattttt

SEQ ID NO: 850597 - DNA, 20 bp, mouse
gaactgagctctgtctaggt

SEQ ID NO: 850598 - DNA, 20 bp, mouse
ggactcacttctgaaaggag

SEQ ID NO: 850599 - DNA, 20 bp, mouse
ggtgtgatagtggctatgga

SEQ ID NO: 850600 - DNA, 20 bp, mouse
gtaggaactgagctctgtct

SEQ ID NO: 850601 - DNA, 20 bp, mouse
gtgttgagaagttcagactt

SEQ ID NO: 850602 - DNA, 20 bp, mouse
gtttggtgtgatagtggcta

SEQ ID NO: 850603 - DNA, 20 bp, mouse
ggatccagcccattgcacat

SEQ ID NO: 850604 - DNA, 20 bp, mouse
gctacagactgaaatattgg

SEQ ID NO: 850605 - DNA, 20 bp, mouse
ggttgcatcctttggacaca

SEQ ID NO: 850606 - DNA, 20 bp, mouse
gcggaacagtctgtgacgag

SEQ ID NO: 850607 - DNA, 20 bp, mouse
gggcgggccagatcggttga

SEQ ID NO: 850608 - DNA, 20 bp, mouse
gggctgcaggcgggccagat

SEQ ID NO: 850609 - DNA, 20 bp, mouse
ggccgtggcccgggctgtca

SEQ ID NO: 850610 - DNA, 20 bp, mouse
gcgtcacagactgttccggg

SEQ ID NO: 850611 - DNA, 20 bp, mouse
ggggcgggacggccgtggcc

SEQ ID NO: 850612 - DNA, 20 bp, mouse
gggctgcgcacggggcgcgt

SEQ ID NO: 850613 - DNA, 20 bp, mouse
gcggttgatggcttcctggg

SEQ ID NO: 850614 - DNA, 20 bp, mouse
gaggaagccatcaaccgatc

SEQ ID NO: 850615 - DNA, 20 bp, mouse
gccgggctgtcaggggctac

SEQ ID NO: 850616 - DNA, 20 bp, mouse
gggagcggcggcagctggaa

SEQ ID NO: 850617 - DNA, 20 bp, mouse
gctccaccagctgactccga

SEQ ID NO: 850618 - DNA, 20 bp, mouse
gaggcccagtccaggctcgt

SEQ ID NO: 850619 - DNA, 20 bp, mouse
gtcccaccccggctggggag

SEQ ID NO: 850620 - DNA, 20 bp, mouse
gtggccagtgctggacgcgg

SEQ ID NO: 850621 - DNA, 20 bp, mouse
ggcaacagcacggcaatcgg

SEQ ID NO: 850622 - DNA, 20 bp, mouse
ggcccctccccagccggggt

SEQ ID NO: 850623 - DNA, 20 bp, mouse
ggcaatcggaggcccagtcc

SEQ ID NO: 850624 - DNA, 20 bp, mouse
ggctgccgccgctcccaccc

SEQ ID NO: 850625 - DNA, 20 bp, mouse
ggacgcggagggcaacagca

SEQ ID NO: 850626 - DNA, 20 bp, mouse
ggaaccgacaggttcttagg

SEQ ID NO: 850627 - DNA, 20 bp, mouse
ggtgtcttacagccgttagg

SEQ ID NO: 850628 - DNA, 20 bp, mouse
gtggggtgaaggcggggaca

SEQ ID NO: 850629 - DNA, 20 bp, mouse
gctgccccctaagaacctgt

SEQ ID NO: 850630 - DNA, 20 bp, mouse
gaacggctgtaagacacaat

SEQ ID NO: 850631 - DNA, 20 bp, mouse
gcggtcccgggcaggggaag

SEQ ID NO: 850632 - DNA, 20 bp, mouse
gagtagggttggggtgaagg

SEQ ID NO: 850633 - DNA, 20 bp, mouse
ggggggcaggaggaaccgac

SEQ ID NO: 850634 - DNA, 20 bp, mouse
gcccctgcccgggaccgggt

SEQ ID NO: 850635 - DNA, 20 bp, mouse
gaccgggttggggaggcttc

SEQ ID NO: 850636 - DNA, 20 bp, mouse
gcctctgcccgcagccggga

SEQ ID NO: 850637 - DNA, 20 bp, mouse
gagctgcgacgcagaggaag

SEQ ID NO: 850638 - DNA, 20 bp, mouse
ggccgaggggtcaacctgat

SEQ ID NO: 850639 - DNA, 20 bp, mouse
ggggcgggacctttgaggga

SEQ ID NO: 850640 - DNA, 20 bp, mouse
gaagcggggagcagacgaac

SEQ ID NO: 850641 - DNA, 20 bp, mouse
gcctcctccagggaacactt

SEQ ID NO: 850642 - DNA, 20 bp, mouse
gagaaactaacacggatgaa

SEQ ID NO: 850643 - DNA, 20 bp, mouse
ggctgtgtctcacctctggc

SEQ ID NO: 850644 - DNA, 20 bp, mouse
ggggacggggagccctggcg

SEQ ID NO: 850645 - DNA, 20 bp, mouse
gagaggggcgggacctttga

SEQ ID NO: 850646 - DNA, 20 bp, mouse
gcaccctcgcatggcttcct

SEQ ID NO: 850647 - DNA, 20 bp, mouse
ggtgggccgccccctgggaa

SEQ ID NO: 850648 - DNA, 20 bp, mouse
gctccgaggaagccatgcga

SEQ ID NO: 850649 - DNA, 20 bp, mouse
gaataattgaggtagagggg

SEQ ID NO: 850650 - DNA, 20 bp, mouse
gtggatgtgggccgccccct

SEQ ID NO: 850651 - DNA, 20 bp, mouse
ggggcgggggcagtcaaagg

SEQ ID NO: 850652 - DNA, 20 bp, mouse
gatagggcgggggcagtcaa

SEQ ID NO: 850653 - DNA, 20 bp, mouse
gcggccccctcccttcccag

SEQ ID NO: 850654 - DNA, 20 bp, mouse
gaagccatgcgagggtgacc

SEQ ID NO: 850655 - DNA, 20 bp, mouse
gaggcagaaagcatgtggtt

SEQ ID NO: 850656 - DNA, 20 bp, mouse
gtgcagagctaggcctctac

SEQ ID NO: 850657 - DNA, 20 bp, mouse
gggctcgctccaccccggac

SEQ ID NO: 850658 - DNA, 20 bp, mouse
gggcggtggggccagtgtag

SEQ ID NO: 850659 - DNA, 20 bp, mouse
gaccccggacggggcgagat

SEQ ID NO: 850660 - DNA, 20 bp, mouse
gggggcggggtctgggcggt

SEQ ID NO: 850661 - DNA, 20 bp, mouse
gcccgctagtccggcaggaa

SEQ ID NO: 850662 - DNA, 20 bp, mouse
gcgcggccccgcccctacac

SEQ ID NO: 850663 - DNA, 20 bp, mouse
gggtggggccagtgtagggg

SEQ ID NO: 850664 - DNA, 20 bp, mouse
ggctgggattccaccacccc

SEQ ID NO: 850665 - DNA, 20 bp, mouse
gccgcgggctcgctccaccc

SEQ ID NO: 850666 - DNA, 20 bp, mouse
gtaaatggtaactatgttaa

SEQ ID NO: 850667 - DNA, 20 bp, mouse
gtgaagaggccattgggcct

SEQ ID NO: 850668 - DNA, 20 bp, mouse
gaggccattgggccttggat

SEQ ID NO: 850669 - DNA, 20 bp, mouse
gagtgttcatgctcacagat

SEQ ID NO: 850670 - DNA, 20 bp, mouse
ggtggtgtgagcacaaaaat

SEQ ID NO: 850671 - DNA, 20 bp, mouse
gagtggcacacgtgactaac

SEQ ID NO: 850672 - DNA, 20 bp, mouse
gtaaaggttggttataaaga

SEQ ID NO: 850673 - DNA, 20 bp, mouse
gtgccactctatctattgat

SEQ ID NO: 850674 - DNA, 20 bp, mouse
gggatgggagtacagatttt

SEQ ID NO: 850675 - DNA, 20 bp, mouse
gatgctttgtcttctcagtg

SEQ ID NO: 850676 - DNA, 20 bp, mouse
gcagatagaggatgctggag

SEQ ID NO: 850677 - DNA, 20 bp, mouse
ggtcctgaatgatgtctcct

SEQ ID NO: 850678 - DNA, 20 bp, mouse
gacttcgggtggggtagtgg

SEQ ID NO: 850679 - DNA, 20 bp, mouse
ggcacctggatgacttcggg

SEQ ID NO: 850680 - DNA, 20 bp, mouse
gcacacctgcctaactgcgt

SEQ ID NO: 850681 - DNA, 20 bp, mouse
gcctaagaccgcctggttag

SEQ ID NO: 850682 - DNA, 20 bp, mouse
gaccccacccgaagtcatcc

SEQ ID NO: 850683 - DNA, 20 bp, mouse
gtagcgaggcacaacacaag

SEQ ID NO: 850684 - DNA, 20 bp, mouse
gaaccaggcggtcttagggg

SEQ ID NO: 850685 - DNA, 20 bp, mouse
gcaggacagtggccttactt

SEQ ID NO: 850686 - DNA, 20 bp, mouse
gtggatcaatttctctcgat

SEQ ID NO: 850687 - DNA, 20 bp, mouse
gttatacaacatgcatgtct

SEQ ID NO: 850688 - DNA, 20 bp, mouse
gcaggaaagggatggaaaga

SEQ ID NO: 850689 - DNA, 20 bp, mouse
gttaaaacacacacaggaaa

SEQ ID NO: 850690 - DNA, 20 bp, mouse
gaacaggatgccaaatcacc

SEQ ID NO: 850691 - DNA, 20 bp, mouse
gaacacacacaggaaaggga

SEQ ID NO: 850692 - DNA, 20 bp, mouse
gcataccttaaaacacacac

SEQ ID NO: 850693 - DNA, 20 bp, mouse
ggtttatttttactatacag

SEQ ID NO: 850694 - DNA, 20 bp, mouse
gggttcgtagaaaatagaac

SEQ ID NO: 850695 - DNA, 20 bp, mouse
gattctagatccaggtgatt

SEQ ID NO: 850696 - DNA, 20 bp, mouse
ggtgctgggcaaaaaggaga

SEQ ID NO: 850697 - DNA, 20 bp, mouse
gccacgggaaagcaggtgag

SEQ ID NO: 850698 - DNA, 20 bp, mouse
ggatacttacataaggtgct

SEQ ID NO: 850699 - DNA, 20 bp, mouse
gctctctctgacacacgttt

SEQ ID NO: 850700 - DNA, 20 bp, mouse
gaatgaagccacgggaaagc

SEQ ID NO: 850701 - DNA, 20 bp, mouse
gaaagaatacacatgcccaa

SEQ ID NO: 850702 - DNA, 20 bp, mouse
gcataaggtgctgggcaaaa

SEQ ID NO: 850703 - DNA, 20 bp, mouse
gtctgtttgcacaagcttgc

SEQ ID NO: 850704 - DNA, 20 bp, mouse
ggaaagcaggtgagtggatg

SEQ ID NO: 850705 - DNA, 20 bp, mouse
gaggagatgggttgcagctg

SEQ ID NO: 850706 - DNA, 20 bp, mouse
gggtccattgggtcctgtga

SEQ ID NO: 850707 - DNA, 20 bp, mouse
ggggccagactgaacacccg

SEQ ID NO: 850708 - DNA, 20 bp, mouse
gaggcctcgggtgttcagtc

SEQ ID NO: 850709 - DNA, 20 bp, mouse
ggaaaattcttttccctcac

SEQ ID NO: 850710 - DNA, 20 bp, mouse
gccagcttgcacacgcgcac

SEQ ID NO: 850711 - DNA, 20 bp, mouse
gctcccattgcagaatgccc

SEQ ID NO: 850712 - DNA, 20 bp, mouse
ggtgtccttttctctctgat

SEQ ID NO: 850713 - DNA, 20 bp, mouse
ggagatgggcaaaatggaga

SEQ ID NO: 850714 - DNA, 20 bp, mouse
gccacgggccatccatcacc

SEQ ID NO: 850715 - DNA, 20 bp, mouse
gaagcaaatgtgagtggatg

SEQ ID NO: 850716 - DNA, 20 bp, mouse
ggggccagactctacaccca

SEQ ID NO: 850717 - DNA, 20 bp, mouse
ggacactgcggtcaaggtat

SEQ ID NO: 850718 - DNA, 20 bp, mouse
gaggccttgggtgtagagtc

SEQ ID NO: 850719 - DNA, 20 bp, mouse
gtgtccagctcagacatccc

SEQ ID NO: 850720 - DNA, 20 bp, mouse
gatgtctgagctggacactg

SEQ ID NO: 850721 - DNA, 20 bp, mouse
ggaaaattcttttgcttcac

SEQ ID NO: 850722 - DNA, 20 bp, mouse
ggagatgggcaaaatggaga

SEQ ID NO: 850723 - DNA, 20 bp, mouse
gccacgggccatccatcacc

SEQ ID NO: 850724 - DNA, 20 bp, mouse
gtggagatggactgtagctg

SEQ ID NO: 850725 - DNA, 20 bp, mouse
gaagcaaatgtgagtggatg

SEQ ID NO: 850726 - DNA, 20 bp, mouse
gcttaaaagtccctttcctg

SEQ ID NO: 850727 - DNA, 20 bp, mouse
gccaggaaaaagccccttct

SEQ ID NO: 850728 - DNA, 20 bp, mouse
gaaaagtccctttcctgagg

SEQ ID NO: 850729 - DNA, 20 bp, mouse
gaggaagtgtggtttaaagg

SEQ ID NO: 850730 - DNA, 20 bp, mouse
ggtaaagctattcctctggc

SEQ ID NO: 850731 - DNA, 20 bp, mouse
gagggacttttaagacagga

SEQ ID NO: 850732 - DNA, 20 bp, mouse
gagcggtaaagctattcctc

SEQ ID NO: 850733 - DNA, 20 bp, mouse
ggaagtcaagtcagcctcaa

SEQ ID NO: 850734 - DNA, 20 bp, mouse
ggcgcctaatacctcaactg

SEQ ID NO: 850735 - DNA, 20 bp, mouse
ggacagtgcgcatgcccttg

SEQ ID NO: 850736 - DNA, 20 bp, mouse
ggggaataaaccagttgcta

SEQ ID NO: 850737 - DNA, 20 bp, mouse
gtgagcgaaggtaagactct

SEQ ID NO: 850738 - DNA, 20 bp, mouse
gcgtacgaagttttgaccag

SEQ ID NO: 850739 - DNA, 20 bp, mouse
gactaagaaatgtataaaat

SEQ ID NO: 850740 - DNA, 20 bp, mouse
gtatacatttcttagtactt

SEQ ID NO: 850741 - DNA, 20 bp, mouse
gttctgtttgttggagcctc

SEQ ID NO: 850742 - DNA, 20 bp, mouse
gtcagctagtccttagcaac

SEQ ID NO: 850743 - DNA, 20 bp, mouse
gtcaaaacttcgtacggctt

SEQ ID NO: 850744 - DNA, 20 bp, mouse
ggcttactctggctataatg

SEQ ID NO: 850745 - DNA, 20 bp, mouse
gtaagcaatacagcttactc

SEQ ID NO: 850746 - DNA, 20 bp, mouse
gcaagtaggggctttttcct

SEQ ID NO: 850747 - DNA, 20 bp, mouse
gaggaagtgtggtttaaagg

SEQ ID NO: 850748 - DNA, 20 bp, mouse
ggtaaagctattcctctggc

SEQ ID NO: 850749 - DNA, 20 bp, mouse
ggtaggggctttttcctggg

SEQ ID NO: 850750 - DNA, 20 bp, mouse
gagggacttttaagacagga

SEQ ID NO: 850751 - DNA, 20 bp, mouse
gagcggtaaagctattcctc

SEQ ID NO: 850752 - DNA, 20 bp, mouse
ggcgcctaatacctcaactg

SEQ ID NO: 850753 - DNA, 20 bp, mouse
ggaagtcaagtcagcctcaa

SEQ ID NO: 850754 - DNA, 20 bp, mouse
ggacagtgcgcatgcccttg

SEQ ID NO: 850755 - DNA, 20 bp, mouse
gctgtcccagccaatcagag

SEQ ID NO: 850756 - DNA, 20 bp, mouse
gaatcatgcatgtgtgactt

SEQ ID NO: 850757 - DNA, 20 bp, mouse
gatgtgtgacttggggctcg

SEQ ID NO: 850758 - DNA, 20 bp, mouse
ggggttctgtgggactgggg

SEQ ID NO: 850759 - DNA, 20 bp, mouse
ggggggtgcgattccctagg

SEQ ID NO: 850760 - DNA, 20 bp, mouse
gtgggccggccatgccatgc

SEQ ID NO: 850761 - DNA, 20 bp, mouse
gggcatggccggcccaaccc

SEQ ID NO: 850762 - DNA, 20 bp, mouse
gaagaggggttctgtgggac

SEQ ID NO: 850763 - DNA, 20 bp, mouse
ggtggggggtgcgattccct

SEQ ID NO: 850764 - DNA, 20 bp, mouse
gctccccggcatggcatggc

SEQ ID NO: 850765 - DNA, 20 bp, mouse
gtcatctcccctccccggca

SEQ ID NO: 850766 - DNA, 20 bp, mouse
ggcctctggtgtattctttt

SEQ ID NO: 850767 - DNA, 20 bp, mouse
gatcttgggtgactgcatca

SEQ ID NO: 850768 - DNA, 20 bp, mouse
gtcttttgggtctctcctgg

SEQ ID NO: 850769 - DNA, 20 bp, mouse
gtattcttttgggtctctcc

SEQ ID NO: 850770 - DNA, 20 bp, mouse
ggaaaggacgtgattggacc

SEQ ID NO: 850771 - DNA, 20 bp, mouse
gacccaaaagaatacaccag

SEQ ID NO: 850772 - DNA, 20 bp, mouse
ggaatctctgcatttgcctc

SEQ ID NO: 850773 - DNA, 20 bp, mouse
gaccaggactccacaggatg

SEQ ID NO: 850774 - DNA, 20 bp, mouse
gaaatgggaaaggacgtgat

SEQ ID NO: 850775 - DNA, 20 bp, mouse
gtgagccctgctgcgcagtc

SEQ ID NO: 850776 - DNA, 20 bp, mouse
gctccagggtgggcgggcca

SEQ ID NO: 850777 - DNA, 20 bp, mouse
gggtccgcgtgtctacagtt

SEQ ID NO: 850778 - DNA, 20 bp, mouse
ggggtactgcacaagttctt

SEQ ID NO: 850779 - DNA, 20 bp, mouse
ggtacccaaagaccccagag

SEQ ID NO: 850780 - DNA, 20 bp, mouse
gttaagacagcggatttttt

SEQ ID NO: 850781 - DNA, 20 bp, mouse
gccttctgcatgggcctctc

SEQ ID NO: 850782 - DNA, 20 bp, mouse
ggaaaacagtgtgggttctt

SEQ ID NO: 850783 - DNA, 20 bp, mouse
gtgccatggcccgcccaccc

SEQ ID NO: 850784 - DNA, 20 bp, mouse
gcatgtgtgacttggggctt

SEQ ID NO: 850785 - DNA, 20 bp, mouse
ggctgtcttaaggttttcaa

SEQ ID NO: 850786 - DNA, 20 bp, mouse
gaatcatgcatgtgtgactt

SEQ ID NO: 850787 - DNA, 20 bp, mouse
gaagacagcggattttttgg

SEQ ID NO: 850788 - DNA, 20 bp, mouse
gcttaagacagcggattttt

SEQ ID NO: 850789 - DNA, 20 bp, mouse
gatgtgtgacttggggctcg

SEQ ID NO: 850790 - DNA, 20 bp, mouse
ggggttctgtgggactgggg

SEQ ID NO: 850791 - DNA, 20 bp, mouse
gaagaggggttctgtgggac

SEQ ID NO: 850792 - DNA, 20 bp, mouse
ggggggtgcgattccctagg

SEQ ID NO: 850793 - DNA, 20 bp, mouse
gtgggccggccatgccatgc

SEQ ID NO: 850794 - DNA, 20 bp, mouse
gggcatggccggcccaaccc

SEQ ID NO: 850795 - DNA, 20 bp, mouse
gtcgcgataccttgttcctc

SEQ ID NO: 850796 - DNA, 20 bp, mouse
gctccagggtgggcgggcca

SEQ ID NO: 850797 - DNA, 20 bp, mouse
gggtccgcgtgtctacagtt

SEQ ID NO: 850798 - DNA, 20 bp, mouse
ggggtactgcacaagttctt

SEQ ID NO: 850799 - DNA, 20 bp, mouse
ggtacccaaagaccccagag

SEQ ID NO: 850800 - DNA, 20 bp, mouse
gttaagacagcggatttttt

SEQ ID NO: 850801 - DNA, 20 bp, mouse
gccttctgcatgggcctctc

SEQ ID NO: 850802 - DNA, 20 bp, mouse
ggaaaacagtgtgggttctt

SEQ ID NO: 850803 - DNA, 20 bp, mouse
gtgccatggcccgcccaccc

SEQ ID NO: 850804 - DNA, 20 bp, mouse
gcatgtgtgacttggggctt

SEQ ID NO: 850805 - DNA, 20 bp, mouse
ggctgtcttaaggttttcaa

SEQ ID NO: 850806 - DNA, 20 bp, mouse
gcgcctgcgcagccgaggag

SEQ ID NO: 850807 - DNA, 20 bp, mouse
gaatccggactaagcgatgg

SEQ ID NO: 850808 - DNA, 20 bp, mouse
gagaacatggaaaagagcat

SEQ ID NO: 850809 - DNA, 20 bp, mouse
gaacaatccggactaagcga

SEQ ID NO: 850810 - DNA, 20 bp, mouse
gtaagcgatgggggagaatc

SEQ ID NO: 850811 - DNA, 20 bp, mouse
gctaaaaagcatgagaaaac

SEQ ID NO: 850812 - DNA, 20 bp, mouse
ggtactgcctcgcccttcat

SEQ ID NO: 850813 - DNA, 20 bp, mouse
gctgcgcagccgaggagtgg

SEQ ID NO: 850814 - DNA, 20 bp, mouse
gcgcagtcgaggagtcctgg

SEQ ID NO: 850815 - DNA, 20 bp, mouse
gaaacccagctgcgggccat

SEQ ID NO: 850816 - DNA, 20 bp, mouse
gcaaactacgagggcgcgaa

SEQ ID NO: 850817 - DNA, 20 bp, mouse
gggggcggggcttccttcga

SEQ ID NO: 850818 - DNA, 20 bp, mouse
gcgcccccatgcaaactacg

SEQ ID NO: 850819 - DNA, 20 bp, mouse
ggggcgcagcgtttgaaaca

SEQ ID NO: 850820 - DNA, 20 bp, mouse
gtggccgcgcccccagccca

SEQ ID NO: 850821 - DNA, 20 bp, mouse
gcgcgcccccagcccagggt

SEQ ID NO: 850822 - DNA, 20 bp, mouse
gggtaggaccacgccctcga

SEQ ID NO: 850823 - DNA, 20 bp, mouse
gagcgcgatgggtagacggg

SEQ ID NO: 850824 - DNA, 20 bp, mouse
gaagaaaagggccatcccac

SEQ ID NO: 850825 - DNA, 20 bp, mouse
gttaggccgccacgcactga

SEQ ID NO: 850826 - DNA, 20 bp, mouse
ggtaaaccccgcccgttcac

SEQ ID NO: 850827 - DNA, 20 bp, mouse
gtgagcacgccacagagggg

SEQ ID NO: 850828 - DNA, 20 bp, mouse
gcccgcccgttcaccggagt

SEQ ID NO: 850829 - DNA, 20 bp, mouse
ggaacgggcggggtttacag

SEQ ID NO: 850830 - DNA, 20 bp, mouse
gcacgcccactccggtgaac

SEQ ID NO: 850831 - DNA, 20 bp, mouse
gaagatcagtgacgactgac

SEQ ID NO: 850832 - DNA, 20 bp, mouse
ggaccggcgcctctcccaat

SEQ ID NO: 850833 - DNA, 20 bp, mouse
ggtgttctgtgcaaccaatt

SEQ ID NO: 850834 - DNA, 20 bp, mouse
gctgtggcgtgctcacgcag

SEQ ID NO: 850835 - DNA, 20 bp, mouse
ggcgtgagcacgccacagag

SEQ ID NO: 850836 - DNA, 20 bp, mouse
gaaacagcttgctggagggt

SEQ ID NO: 850837 - DNA, 20 bp, mouse
gtagggtagagctgctgaag

SEQ ID NO: 850838 - DNA, 20 bp, mouse
gagggtgtgagcctgcccct

SEQ ID NO: 850839 - DNA, 20 bp, mouse
gttagaggaggaatagaagt

SEQ ID NO: 850840 - DNA, 20 bp, mouse
ggtgcctgatgtgagctaat

SEQ ID NO: 850841 - DNA, 20 bp, mouse
gagctgctgaagaggggggc

SEQ ID NO: 850842 - DNA, 20 bp, mouse
gctatcccaaagcaaaagca

SEQ ID NO: 850843 - DNA, 20 bp, mouse
gccactcccacacccagatc

SEQ ID NO: 850844 - DNA, 20 bp, mouse
gtgcagccctgcttttgctt

SEQ ID NO: 850845 - DNA, 20 bp, mouse
gataggaaacagcttgctgg

SEQ ID NO: 850846 - DNA, 20 bp, mouse
gcgagacgccgcatggagga

SEQ ID NO: 850847 - DNA, 20 bp, mouse
gaaggggccgagcagttgac

SEQ ID NO: 850848 - DNA, 20 bp, mouse
gtcgaagcaggcattgtcac

SEQ ID NO: 850849 - DNA, 20 bp, mouse
gtcaacgtgaccaagtggaa

SEQ ID NO: 850850 - DNA, 20 bp, mouse
gggtcacgaggccgttgggg

SEQ ID NO: 850851 - DNA, 20 bp, mouse
gagaacgagacgccgcatgg

SEQ ID NO: 850852 - DNA, 20 bp, mouse
gcggccccttccggcaggcg

SEQ ID NO: 850853 - DNA, 20 bp, mouse
gtcccggggaattaggtcag

SEQ ID NO: 850854 - DNA, 20 bp, mouse
ggcgggctttcttcccgggg

SEQ ID NO: 850855 - DNA, 20 bp, mouse
gcgagccgcgcctgccggaa

SEQ ID NO: 850856 - DNA, 20 bp, mouse
ggctccgaccaataagaggt

SEQ ID NO: 850857 - DNA, 20 bp, mouse
gaggccgcgcgcccattggt

SEQ ID NO: 850858 - DNA, 20 bp, mouse
ggtggccggggccgaccaat

SEQ ID NO: 850859 - DNA, 20 bp, mouse
ggaggcggggcgggacgcaa

SEQ ID NO: 850860 - DNA, 20 bp, mouse
ggggcgctccgaccaataag

SEQ ID NO: 850861 - DNA, 20 bp, mouse
ggcgggacgcaaaggagtga

SEQ ID NO: 850862 - DNA, 20 bp, mouse
gcctaagcggcaggctcgtg

SEQ ID NO: 850863 - DNA, 20 bp, mouse
gaagaggtaggctgatggcg

SEQ ID NO: 850864 - DNA, 20 bp, mouse
gcactgctggaaagaggcgg

SEQ ID NO: 850865 - DNA, 20 bp, mouse
gacgcaaaggagtgaggggg

SEQ ID NO: 850866 - DNA, 20 bp, mouse
ggctcggcctcgcccggtgc

SEQ ID NO: 850867 - DNA, 20 bp, mouse
ggcggccgggcatcccgcgc

SEQ ID NO: 850868 - DNA, 20 bp, mouse
gcggtcccgtcaggccgctg

SEQ ID NO: 850869 - DNA, 20 bp, mouse
gagcgggaggcatgaattct

SEQ ID NO: 850870 - DNA, 20 bp, mouse
gacaagcgtgagcccggtcg

SEQ ID NO: 850871 - DNA, 20 bp, mouse
gtagctgcgggttaaggttt

SEQ ID NO: 850872 - DNA, 20 bp, mouse
gctaacgggctgcgcggctc

SEQ ID NO: 850873 - DNA, 20 bp, mouse
gaagccaagtggttagggag

SEQ ID NO: 850874 - DNA, 20 bp, mouse
ggcgcccccagcggcctgac

SEQ ID NO: 850875 - DNA, 20 bp, mouse
gaggctgtccggtgtggagc

SEQ ID NO: 850876 - DNA, 20 bp, mouse
gctggggaacggaagttccg

SEQ ID NO: 850877 - DNA, 20 bp, mouse
gcgcgcggaagtggccgctt

SEQ ID NO: 850878 - DNA, 20 bp, mouse
ggcgcggccgtcacccgaag

SEQ ID NO: 850879 - DNA, 20 bp, mouse
gaagtggccgcttcgggtga

SEQ ID NO: 850880 - DNA, 20 bp, mouse
gagtcccagaagttggagct

SEQ ID NO: 850881 - DNA, 20 bp, mouse
gccgcgcgcgccgcgaggga

SEQ ID NO: 850882 - DNA, 20 bp, mouse
ggcgcgtcaaccgtccctcg

SEQ ID NO: 850883 - DNA, 20 bp, mouse
gggaagggctgttggctcgg

SEQ ID NO: 850884 - DNA, 20 bp, mouse
ggagcctagggctacctact

SEQ ID NO: 850885 - DNA, 20 bp, mouse
gtgaactccaaatttcctct

SEQ ID NO: 850886 - DNA, 20 bp, mouse
gggaccgccgcgttggtaaa

SEQ ID NO: 850887 - DNA, 20 bp, mouse
gcggcggtccctggcctctt

SEQ ID NO: 850888 - DNA, 20 bp, mouse
gaggccagggaccgccgcgt

SEQ ID NO: 850889 - DNA, 20 bp, mouse
gtgtccctttaccaacgcgg

SEQ ID NO: 850890 - DNA, 20 bp, mouse
gcggtccctggcctcttggg

SEQ ID NO: 850891 - DNA, 20 bp, mouse
gtcttgggcggggacgtggt

SEQ ID NO: 850892 - DNA, 20 bp, mouse
ggcggggccagtgaacagtc

SEQ ID NO: 850893 - DNA, 20 bp, mouse
ggccgcacctgactgttcac

SEQ ID NO: 850894 - DNA, 20 bp, mouse
ggggcggggacgtggtgggc

SEQ ID NO: 850895 - DNA, 20 bp, mouse
gcgtccccgcccaagaggcc

SEQ ID NO: 850896 - DNA, 20 bp, mouse
gggggcgcgggcaacgtcag

SEQ ID NO: 850897 - DNA, 20 bp, mouse
gtcctcccacccggcgtctc

SEQ ID NO: 850898 - DNA, 20 bp, mouse
ggagggccgtggaagcgcaa

SEQ ID NO: 850899 - DNA, 20 bp, mouse
gaggccccggccggccgctc

SEQ ID NO: 850900 - DNA, 20 bp, mouse
gcggcccggagacgccgggt

SEQ ID NO: 850901 - DNA, 20 bp, mouse
gctgccgcgcaggccccggc

SEQ ID NO: 850902 - DNA, 20 bp, mouse
gtgggacggcgtaggggcgc

SEQ ID NO: 850903 - DNA, 20 bp, mouse
ggtcagcggcccggagacgc

SEQ ID NO: 850904 - DNA, 20 bp, mouse
gggccgtggaagcgcaaggg

SEQ ID NO: 850905 - DNA, 20 bp, mouse
gggccagcgccgcgtgggag

SEQ ID NO: 850906 - DNA, 20 bp, mouse
ggctccctggagctcgcagg

SEQ ID NO: 850907 - DNA, 20 bp, mouse
gctgaccagacccttctgga

SEQ ID NO: 850908 - DNA, 20 bp, mouse
gtaacctgtagctaggaggg

SEQ ID NO: 850909 - DNA, 20 bp, mouse
gggtccgcgcggtacgacgc

SEQ ID NO: 850910 - DNA, 20 bp, mouse
gcgggcctgtggtgcatgct

SEQ ID NO: 850911 - DNA, 20 bp, mouse
gacgccccctgcgagctcca

SEQ ID NO: 850912 - DNA, 20 bp, mouse
gggaccgcgcacgtgctccc

SEQ ID NO: 850913 - DNA, 20 bp, mouse
gcagtaacctgtagctagga

SEQ ID NO: 850914 - DNA, 20 bp, mouse
gaagcagagcgcaacgtggc

SEQ ID NO: 850915 - DNA, 20 bp, mouse
gagtgcggagatcctgagat

SEQ ID NO: 850916 - DNA, 20 bp, mouse
gtacgccgctccgacggagg

SEQ ID NO: 850917 - DNA, 20 bp, mouse
gccaaaggggcggagcaaga

SEQ ID NO: 850918 - DNA, 20 bp, mouse
ggactggaggcaggcggaag

SEQ ID NO: 850919 - DNA, 20 bp, mouse
ggcagctgtaggcagactgg

SEQ ID NO: 850920 - DNA, 20 bp, mouse
ggagtgtagaaagcagctgt

SEQ ID NO: 850921 - DNA, 20 bp, mouse
gcaacattgttgtttttccc

SEQ ID NO: 850922 - DNA, 20 bp, mouse
gcccgccccctccgtcggag

SEQ ID NO: 850923 - DNA, 20 bp, mouse
gctgtaggcagactggaggc

SEQ ID NO: 850924 - DNA, 20 bp, mouse
gttcccacgtccggcccaaa

SEQ ID NO: 850925 - DNA, 20 bp, mouse
gcctctagacgtcatcgcca

SEQ ID NO: 850926 - DNA, 20 bp, mouse
ggaacccggcgcctcgctcg

SEQ ID NO: 850927 - DNA, 20 bp, mouse
gcggctaggccggagagtgg

SEQ ID NO: 850928 - DNA, 20 bp, mouse
gaggcggctaggccggagag

SEQ ID NO: 850929 - DNA, 20 bp, mouse
ggcaacaggcattccccctc

SEQ ID NO: 850930 - DNA, 20 bp, mouse
ggagtctccacgttatcagg

SEQ ID NO: 850931 - DNA, 20 bp, mouse
gggcccccggagaaggttgg

SEQ ID NO: 850932 - DNA, 20 bp, mouse
ggggaacctagcaacaagag

SEQ ID NO: 850933 - DNA, 20 bp, mouse
gaccagggcaaattacacgt

SEQ ID NO: 850934 - DNA, 20 bp, mouse
gctcccccaaccttctccgg

SEQ ID NO: 850935 - DNA, 20 bp, mouse
gctctccgcgagcgaggcgc

SEQ ID NO: 850936 - DNA, 20 bp, mouse
gggcatgcgcagtaaagctg

SEQ ID NO: 850937 - DNA, 20 bp, mouse
ggagactggcgtcaccaaga

SEQ ID NO: 850938 - DNA, 20 bp, mouse
gagtaactgaagataacata

SEQ ID NO: 850939 - DNA, 20 bp, mouse
gtaaagctgcggcgccctct

SEQ ID NO: 850940 - DNA, 20 bp, mouse
gtcggagccagagaagccga

SEQ ID NO: 850941 - DNA, 20 bp, mouse
gtgtgcgcgtgcgcactgtg

SEQ ID NO: 850942 - DNA, 20 bp, mouse
gatctcgacgggtctttatc

SEQ ID NO: 850943 - DNA, 20 bp, mouse
gcgtgcgcactgtgcgggct

SEQ ID NO: 850944 - DNA, 20 bp, mouse
gttcagttactcatctcgac

SEQ ID NO: 850945 - DNA, 20 bp, mouse
gtaaggactaaaggaaacgc

SEQ ID NO: 850946 - DNA, 20 bp, mouse
gcctacggctggccaccaat

SEQ ID NO: 850947 - DNA, 20 bp, mouse
ggggcaccctcgcccctcta

SEQ ID NO: 850948 - DNA, 20 bp, mouse
gacggctggccaccaatcgg

SEQ ID NO: 850949 - DNA, 20 bp, mouse
gaatcggcggtgaagaccgg

SEQ ID NO: 850950 - DNA, 20 bp, mouse
gccacccagaagaaacgaag

SEQ ID NO: 850951 - DNA, 20 bp, mouse
gactctccctagaggggcga

SEQ ID NO: 850952 - DNA, 20 bp, mouse
gtctagggagagtgtgactt

SEQ ID NO: 850953 - DNA, 20 bp, mouse
gaggggcgagggtgcccctc

SEQ ID NO: 850954 - DNA, 20 bp, mouse
gggagagtgtgacttcggat

SEQ ID NO: 850955 - DNA, 20 bp, mouse
gtggtggccagccgtagggg

SEQ ID NO: 850956 - DNA, 20 bp, mouse
gcccacctgggaaatgtgac

SEQ ID NO: 850957 - DNA, 20 bp, mouse
gctccgcccacagcctgcta

SEQ ID NO: 850958 - DNA, 20 bp, mouse
ggcacatgcaacatgggtga

SEQ ID NO: 850959 - DNA, 20 bp, mouse
gacaggccctagcaggctgt

SEQ ID NO: 850960 - DNA, 20 bp, mouse
gagtgctggcacatgcaaca

SEQ ID NO: 850961 - DNA, 20 bp, mouse
ggaagggtgtgggcccacct

SEQ ID NO: 850962 - DNA, 20 bp, mouse
gtgcaacatgggtgaaggac

SEQ ID NO: 850963 - DNA, 20 bp, mouse
gcaggctgtgggcggagtgc

SEQ ID NO: 850964 - DNA, 20 bp, mouse
ggtccaccagggaagggtgt

SEQ ID NO: 850965 - DNA, 20 bp, mouse
gtgggcggagtgcgggctgt

SEQ ID NO: 850966 - DNA, 20 bp, mouse
gagtctgaatggtgcggcat

SEQ ID NO: 850967 - DNA, 20 bp, mouse
gccggggcggaagaggatgc

SEQ ID NO: 850968 - DNA, 20 bp, mouse
gagcgagcgggaagcacagc

SEQ ID NO: 850969 - DNA, 20 bp, mouse
gaatggtgcggcatgggcgg

SEQ ID NO: 850970 - DNA, 20 bp, mouse
gccgccgagaaactcaaccg

SEQ ID NO: 850971 - DNA, 20 bp, mouse
ggcgccgcgataggtccaac

SEQ ID NO: 850972 - DNA, 20 bp, mouse
gcggggcggcggggatggtg

SEQ ID NO: 850973 - DNA, 20 bp, mouse
gggtccggttggacctatcg

SEQ ID NO: 850974 - DNA, 20 bp, mouse
gctcactatggtaagaacct

SEQ ID NO: 850975 - DNA, 20 bp, mouse
gaacctgggcttcctggccg

SEQ ID NO: 850976 - DNA, 20 bp, mouse
gtgcaaggcggggaagccat

SEQ ID NO: 850977 - DNA, 20 bp, mouse
gaacaaagccttgcctaagg

SEQ ID NO: 850978 - DNA, 20 bp, mouse
gagggcgtcagatccgcgga

SEQ ID NO: 850979 - DNA, 20 bp, mouse
gctaaaagccagtcagtact

SEQ ID NO: 850980 - DNA, 20 bp, mouse
ggcttccccgccttgcacgc

SEQ ID NO: 850981 - DNA, 20 bp, mouse
ggagcttgaatgggctcgtc

SEQ ID NO: 850982 - DNA, 20 bp, mouse
ggggtgcctggagcttgaat

SEQ ID NO: 850983 - DNA, 20 bp, mouse
gacgtcccgcgtgcaaggcg

SEQ ID NO: 850984 - DNA, 20 bp, mouse
gtatgcacgcggctgcatgt

SEQ ID NO: 850985 - DNA, 20 bp, mouse
gcacctacatcagccttccg

SEQ ID NO: 850986 - DNA, 20 bp, mouse
gcggtgctgacgggtttcgg

SEQ ID NO: 850987 - DNA, 20 bp, mouse
ggccctcgggcacccggcag

SEQ ID NO: 850988 - DNA, 20 bp, mouse
gtgcccgcttgaagggtcga

SEQ ID NO: 850989 - DNA, 20 bp, mouse
gaccggcaacgactactgtg

SEQ ID NO: 850990 - DNA, 20 bp, mouse
ggggcggagcttcaagcgag

SEQ ID NO: 850991 - DNA, 20 bp, mouse
gcgcacggaacagggggcag

SEQ ID NO: 850992 - DNA, 20 bp, mouse
ggtggggagaagagggagcg

SEQ ID NO: 850993 - DNA, 20 bp, mouse
gagactccgcacggaacagg

SEQ ID NO: 850994 - DNA, 20 bp, mouse
gggaagcgggaaatgcgagt

SEQ ID NO: 850995 - DNA, 20 bp, mouse
ggagcttcaagcgaggggcg

SEQ ID NO: 850996 - DNA, 20 bp, mouse
gaaacagcaggtgagggagt

SEQ ID NO: 850997 - DNA, 20 bp, mouse
gggccagcacgaaggagacg

SEQ ID NO: 850998 - DNA, 20 bp, mouse
gggtaggcgtggtcggtggg

SEQ ID NO: 850999 - DNA, 20 bp, mouse
ggcctcgcgaccgccgatgc

SEQ ID NO: 851000 - DNA, 20 bp, mouse
ggcggcgtgcagctcgtggg

SEQ ID NO: 851001 - DNA, 20 bp, mouse
gtaagagaaacagcaggtga

SEQ ID NO: 851002 - DNA, 20 bp, mouse
gcaagaggagggttgatgaa

SEQ ID NO: 851003 - DNA, 20 bp, mouse
gatatagtggccagcatcgg

SEQ ID NO: 851004 - DNA, 20 bp, mouse
ggctccgcgggccagcacga

SEQ ID NO: 851005 - DNA, 20 bp, mouse
ggtcggtgggcggggctgat

SEQ ID NO: 851006 - DNA, 20 bp, mouse
ggcctccggccgtcgctcgg

SEQ ID NO: 851007 - DNA, 20 bp, mouse
ggcgctgtcaccaacgagta

SEQ ID NO: 851008 - DNA, 20 bp, mouse
gagaccatagagcaaaccgt

SEQ ID NO: 851009 - DNA, 20 bp, mouse
gtagaggggcaggacggcgc

SEQ ID NO: 851010 - DNA, 20 bp, mouse
gttgcgcattaggtgagctc

SEQ ID NO: 851011 - DNA, 20 bp, mouse
gtcgttggtgacagcgcaag

SEQ ID NO: 851012 - DNA, 20 bp, mouse
gagcaaaccgtgggcctaga

SEQ ID NO: 851013 - DNA, 20 bp, mouse
ggacggcgctggtgggcggt

SEQ ID NO: 851014 - DNA, 20 bp, mouse
gggaactgaagaagctctga

SEQ ID NO: 851015 - DNA, 20 bp, mouse
gaggcccacggtttgctcta

SEQ ID NO: 851016 - DNA, 20 bp, mouse
ggaaggcatccgccaggagt

SEQ ID NO: 851017 - DNA, 20 bp, mouse
gcaccaccgcgggggatgca

SEQ ID NO: 851018 - DNA, 20 bp, mouse
ggccaggagtcggctctcaa

SEQ ID NO: 851019 - DNA, 20 bp, mouse
ggctgggcgagctgtagacc

SEQ ID NO: 851020 - DNA, 20 bp, mouse
gtgtggccgagactttggaa

SEQ ID NO: 851021 - DNA, 20 bp, mouse
gccggagtggaggcccggct

SEQ ID NO: 851022 - DNA, 20 bp, mouse
gccggccgctgaacgcacgt

SEQ ID NO: 851023 - DNA, 20 bp, mouse
gggaagttcatttagactgc

SEQ ID NO: 851024 - DNA, 20 bp, mouse
gggaaaggagctcggttaag

SEQ ID NO: 851025 - DNA, 20 bp, mouse
ggactgccggagtggaggcc

SEQ ID NO: 851026 - DNA, 20 bp, mouse
gccagactacggatcccgat

SEQ ID NO: 851027 - DNA, 20 bp, mouse
gtagtctggtgtgctgatga

SEQ ID NO: 851028 - DNA, 20 bp, mouse
gaggcagcgcagagcccatc

SEQ ID NO: 851029 - DNA, 20 bp, mouse
gagggctgaaagaggccgcg

SEQ ID NO: 851030 - DNA, 20 bp, mouse
gaggatgtggctagcaacgg

SEQ ID NO: 851031 - DNA, 20 bp, mouse
gggcttcggacaagtcgtat

SEQ ID NO: 851032 - DNA, 20 bp, mouse
gtcggacaagtcgtatggga

SEQ ID NO: 851033 - DNA, 20 bp, mouse
gagcttcagccaatcggctt

SEQ ID NO: 851034 - DNA, 20 bp, mouse
gcgtcgcagggtgggagaag

SEQ ID NO: 851035 - DNA, 20 bp, mouse
ggacacggagggagacaaga

SEQ ID NO: 851036 - DNA, 20 bp, mouse
gtagctggccaacgcagtcc

SEQ ID NO: 851037 - DNA, 20 bp, mouse
gttggctgccaagcttgaga

SEQ ID NO: 851038 - DNA, 20 bp, mouse
ggccaggtcctaaattccga

SEQ ID NO: 851039 - DNA, 20 bp, mouse
gtggcagccaaaatctgcac

SEQ ID NO: 851040 - DNA, 20 bp, mouse
gaatctgcacgggccatctg

SEQ ID NO: 851041 - DNA, 20 bp, mouse
gctgacagcctggactgcgt

SEQ ID NO: 851042 - DNA, 20 bp, mouse
gcatctgcggtctaatccct

SEQ ID NO: 851043 - DNA, 20 bp, mouse
gagcgtggatacctaaaagg

SEQ ID NO: 851044 - DNA, 20 bp, mouse
gaggtatccacgctcgtgat

SEQ ID NO: 851045 - DNA, 20 bp, mouse
ggccggcggcggccatggag

SEQ ID NO: 851046 - DNA, 20 bp, mouse
gtcggcgcaggggtgagtgt

SEQ ID NO: 851047 - DNA, 20 bp, mouse
gtgggtggagtgaaattgga

SEQ ID NO: 851048 - DNA, 20 bp, mouse
gactgcgctgccttgctggt

SEQ ID NO: 851049 - DNA, 20 bp, mouse
ggccacgccccgcaggactc

SEQ ID NO: 851050 - DNA, 20 bp, mouse
gagtgtgggtggagtgaaat

SEQ ID NO: 851051 - DNA, 20 bp, mouse
gtcgcgagtgggactgcgtc

SEQ ID NO: 851052 - DNA, 20 bp, mouse
gctgcgggaaggtcgcgagt

SEQ ID NO: 851053 - DNA, 20 bp, mouse
gtggactggagtcacgaggc

SEQ ID NO: 851054 - DNA, 20 bp, mouse
gctctggcgtctctgagcga

SEQ ID NO: 851055 - DNA, 20 bp, mouse
ggtgggactgcgtctggctg

SEQ ID NO: 851056 - DNA, 20 bp, mouse
ggcccgccctagaaccctgg

SEQ ID NO: 851057 - DNA, 20 bp, mouse
ggaccctgacccagggaaaa

SEQ ID NO: 851058 - DNA, 20 bp, mouse
gcgcgcgcggggacacggct

SEQ ID NO: 851059 - DNA, 20 bp, mouse
ggaaccctgggggttgggtt

SEQ ID NO: 851060 - DNA, 20 bp, mouse
ggtccccaacccaaccccca

SEQ ID NO: 851061 - DNA, 20 bp, mouse
gaaggggccactagggacgc

SEQ ID NO: 851062 - DNA, 20 bp, mouse
gagggaaaagggaatctcga

SEQ ID NO: 851063 - DNA, 20 bp, mouse
gcccaacccccagggttcta

SEQ ID NO: 851064 - DNA, 20 bp, mouse
ggcgggcgttaggggtacca

SEQ ID NO: 851065 - DNA, 20 bp, mouse
gacacggctcggaagggagc

SEQ ID NO: 851066 - DNA, 20 bp, mouse
gcatctgggcggagtgagga

SEQ ID NO: 851067 - DNA, 20 bp, mouse
gcgaggccccaccctctcgt

SEQ ID NO: 851068 - DNA, 20 bp, mouse
ggcccagcccacgagagggt

SEQ ID NO: 851069 - DNA, 20 bp, mouse
gcctctcgtgggctgggcgt

SEQ ID NO: 851070 - DNA, 20 bp, mouse
ggggctgggcgtggggcagt

SEQ ID NO: 851071 - DNA, 20 bp, mouse
ggcagacactcatagagatg

SEQ ID NO: 851072 - DNA, 20 bp, mouse
gccggagtgcggaggatctg

SEQ ID NO: 851073 - DNA, 20 bp, mouse
gcagatgggcgggcaaaggg

SEQ ID NO: 851074 - DNA, 20 bp, mouse
gaaagcattgtcccggagtg

SEQ ID NO: 851075 - DNA, 20 bp, mouse
gctgggcgtggggcagtagg

SEQ ID NO: 851076 - DNA, 20 bp, mouse
gctgcccatcccagaggcgt

SEQ ID NO: 851077 - DNA, 20 bp, mouse
ggctaagtcccaccattcaa

SEQ ID NO: 851078 - DNA, 20 bp, mouse
gtgggacggaggggcgtgtg

SEQ ID NO: 851079 - DNA, 20 bp, mouse
gaatctcagcccttgaatgg

SEQ ID NO: 851080 - DNA, 20 bp, mouse
ggcgtgtgcggctccccttg

SEQ ID NO: 851081 - DNA, 20 bp, mouse
gcccacgctgcccatcccag

SEQ ID NO: 851082 - DNA, 20 bp, mouse
ggacaaggcgtgggacggag

SEQ ID NO: 851083 - DNA, 20 bp, mouse
gggacgaaaggacaaggcgt

SEQ ID NO: 851084 - DNA, 20 bp, mouse
gtgaaagctgattctaggat

SEQ ID NO: 851085 - DNA, 20 bp, mouse
gggggcgggacgaaaggaca

SEQ ID NO: 851086 - DNA, 20 bp, mouse
gtccccgcgtttgaagtctc

SEQ ID NO: 851087 - DNA, 20 bp, mouse
gccacggccggagcgctccg

SEQ ID NO: 851088 - DNA, 20 bp, mouse
gggggagcgcggcccagcac

SEQ ID NO: 851089 - DNA, 20 bp, mouse
gacgcagcctccagctgtcg

SEQ ID NO: 851090 - DNA, 20 bp, mouse
gccgggcgcacgcgtgtctg

SEQ ID NO: 851091 - DNA, 20 bp, mouse
ggctgcgtgggatccggcgg

SEQ ID NO: 851092 - DNA, 20 bp, mouse
ggcctcacggggctctgcag

SEQ ID NO: 851093 - DNA, 20 bp, mouse
ggcgccggagacttcaaacg

SEQ ID NO: 851094 - DNA, 20 bp, mouse
gggtcgcttccccagaagga

SEQ ID NO: 851095 - DNA, 20 bp, mouse
ggggaagcgacccagaggct

SEQ ID NO: 851096 - DNA, 20 bp, mouse
ggtcgcccccgggtcacgtg

SEQ ID NO: 851097 - DNA, 20 bp, mouse
gcccgcccgcaccgaatccg

SEQ ID NO: 851098 - DNA, 20 bp, mouse
ggggccgcgggccgcggatt

SEQ ID NO: 851099 - DNA, 20 bp, mouse
gcccggccgcacgtgacccg

SEQ ID NO: 851100 - DNA, 20 bp, mouse
gtgcgtgcgcacccaccggc

SEQ ID NO: 851101 - DNA, 20 bp, mouse
gggacccgcgcgcaacgcca

SEQ ID NO: 851102 - DNA, 20 bp, mouse
gcccccgggtcacgtgcggc

SEQ ID NO: 851103 - DNA, 20 bp, mouse
gcggctcggggccggccggt

SEQ ID NO: 851104 - DNA, 20 bp, mouse
ggcgctgcgtgcgcacccac

SEQ ID NO: 851105 - DNA, 20 bp, mouse
gcgggacaaccggcttggta

SEQ ID NO: 851106 - DNA, 20 bp, mouse
gccctgagagggtgcgtcat

SEQ ID NO: 851107 - DNA, 20 bp, mouse
ggcagcggggccaacaccag

SEQ ID NO: 851108 - DNA, 20 bp, mouse
gagggcaagcaagcagtgat

SEQ ID NO: 851109 - DNA, 20 bp, mouse
gaaaccgccccgcccctgag

SEQ ID NO: 851110 - DNA, 20 bp, mouse
ggggatgctcggggagagga

SEQ ID NO: 851111 - DNA, 20 bp, mouse
ggcccatgacgcaccctctc

SEQ ID NO: 851112 - DNA, 20 bp, mouse
gcaagcaagcagtgattggc

SEQ ID NO: 851113 - DNA, 20 bp, mouse
gggtgggggaggtcgtgaag

SEQ ID NO: 851114 - DNA, 20 bp, mouse
ggacccctcgcctagacgac

SEQ ID NO: 851115 - DNA, 20 bp, mouse
gggggccaacaccaggggga

SEQ ID NO: 851116 - DNA, 20 bp, mouse
ggaccctcgtagccagacca

SEQ ID NO: 851117 - DNA, 20 bp, mouse
gggcgcgcggggaatgctgg

SEQ ID NO: 851118 - DNA, 20 bp, mouse
ggtagccagaccagggactg

SEQ ID NO: 851119 - DNA, 20 bp, mouse
gccccccagacggtgtactg

SEQ ID NO: 851120 - DNA, 20 bp, mouse
ggtccctggtctggctacga

SEQ ID NO: 851121 - DNA, 20 bp, mouse
gcatgctcgggcgtagcggg

SEQ ID NO: 851122 - DNA, 20 bp, mouse
gagggcccgcggcttgttca

SEQ ID NO: 851123 - DNA, 20 bp, mouse
gaatgatagaggaacagcgg

SEQ ID NO: 851124 - DNA, 20 bp, mouse
gcgggaggcctgttaggctt

SEQ ID NO: 851125 - DNA, 20 bp, mouse
gctgcggcggtcaaagagtt

SEQ ID NO: 851126 - DNA, 20 bp, mouse
ggaggctgcacgcagactgt

SEQ ID NO: 851127 - DNA, 20 bp, mouse
gtgtgggcgagcacaagcgc

SEQ ID NO: 851128 - DNA, 20 bp, mouse
gtctgcgtgcagcctctacc

SEQ ID NO: 851129 - DNA, 20 bp, mouse
gaagacacaagggacagcgg

SEQ ID NO: 851130 - DNA, 20 bp, mouse
gcaactcggcaaagacacaa

SEQ ID NO: 851131 - DNA, 20 bp, mouse
gtggcgacagtggccgtatc

SEQ ID NO: 851132 - DNA, 20 bp, mouse
gggtgcggtgggcccggtag

SEQ ID NO: 851133 - DNA, 20 bp, mouse
gacaaaccggccactggagc

SEQ ID NO: 851134 - DNA, 20 bp, mouse
gggagcaagtccgccagata

SEQ ID NO: 851135 - DNA, 20 bp, mouse
gccaccgcaccgcaacaaac

SEQ ID NO: 851136 - DNA, 20 bp, mouse
gcctccgccgccatagagac

SEQ ID NO: 851137 - DNA, 20 bp, mouse
ggcctgagaagctgtgggtc

SEQ ID NO: 851138 - DNA, 20 bp, mouse
gggaaggagccccttctagg

SEQ ID NO: 851139 - DNA, 20 bp, mouse
ggcgtcctcccggtactcta

SEQ ID NO: 851140 - DNA, 20 bp, mouse
gcgcctgcgtggtccctcca

SEQ ID NO: 851141 - DNA, 20 bp, mouse
gaggcgctagagacccggtc

SEQ ID NO: 851142 - DNA, 20 bp, mouse
gaatgagagcgcaggagccg

SEQ ID NO: 851143 - DNA, 20 bp, mouse
gccgcggagcgtgagccaat

SEQ ID NO: 851144 - DNA, 20 bp, mouse
gcagagggaacgttcccaga

SEQ ID NO: 851145 - DNA, 20 bp, mouse
gcggtactctatggtgctca

SEQ ID NO: 851146 - DNA, 20 bp, mouse
gagccgaggccaatcgcagt

SEQ ID NO: 851147 - DNA, 20 bp, mouse
gcgtagccgcgcagcccccc

SEQ ID NO: 851148 - DNA, 20 bp, mouse
gtgccgcgggccctgagccg

SEQ ID NO: 851149 - DNA, 20 bp, mouse
gtcccgcggccggtggaaag

SEQ ID NO: 851150 - DNA, 20 bp, mouse
gcccccacccgggtcgtcag

SEQ ID NO: 851151 - DNA, 20 bp, mouse
gcgagggcatcacgtggcgg

SEQ ID NO: 851152 - DNA, 20 bp, mouse
gcggccgcgggaaatcaaac

SEQ ID NO: 851153 - DNA, 20 bp, mouse
gtacttacggagttgcggga

SEQ ID NO: 851154 - DNA, 20 bp, mouse
gcgcggctacgattggccgg

SEQ ID NO: 851155 - DNA, 20 bp, mouse
gggggctgcgcggctacgat

SEQ ID NO: 851156 - DNA, 20 bp, mouse
gcccggagctggttagtccg

SEQ ID NO: 851157 - DNA, 20 bp, mouse
gcacccgggcgaggtcgccg

SEQ ID NO: 851158 - DNA, 20 bp, mouse
ggcggcgggcggcggctcga

SEQ ID NO: 851159 - DNA, 20 bp, mouse
gtccccggactaaccagctc

SEQ ID NO: 851160 - DNA, 20 bp, mouse
gtgggcccactccacctctc

SEQ ID NO: 851161 - DNA, 20 bp, mouse
gtaaaggcgcccgcgctact

SEQ ID NO: 851162 - DNA, 20 bp, mouse
gcgcccgcgagcacttgcgc

SEQ ID NO: 851163 - DNA, 20 bp, mouse
ggcgcccgcgctactcggca

SEQ ID NO: 851164 - DNA, 20 bp, mouse
ggctccgcggcgacctcgcc

SEQ ID NO: 851165 - DNA, 20 bp, mouse
gctcaggtgaaagacgtctt

SEQ ID NO: 851166 - DNA, 20 bp, mouse
ggggcctcggcagcgttcga

SEQ ID NO: 851167 - DNA, 20 bp, mouse
gtaggcgtgtgcgtcggggt

SEQ ID NO: 851168 - DNA, 20 bp, mouse
ggcggcttgcagccgcattt

SEQ ID NO: 851169 - DNA, 20 bp, mouse
gctctaggtggcgagaacaa

SEQ ID NO: 851170 - DNA, 20 bp, mouse
gcctcggcagcgttcgaggg

SEQ ID NO: 851171 - DNA, 20 bp, mouse
gcgacgcacacgcctaaatg

SEQ ID NO: 851172 - DNA, 20 bp, mouse
gagcgttcgagggcggggtc

SEQ ID NO: 851173 - DNA, 20 bp, mouse
gaaatttgcagagcgttagc

SEQ ID NO: 851174 - DNA, 20 bp, mouse
gtaggtggcgagaacaatgg

SEQ ID NO: 851175 - DNA, 20 bp, mouse
gaggacattcagagacctct

SEQ ID NO: 851176 - DNA, 20 bp, mouse
gaaggtgcgacgcagagttc

SEQ ID NO: 851177 - DNA, 20 bp, mouse
ggccccgcacgtcacctcga

SEQ ID NO: 851178 - DNA, 20 bp, mouse
gtcagcaggaagacaacggt

SEQ ID NO: 851179 - DNA, 20 bp, mouse
gcggggtaatacttgtagtc

SEQ ID NO: 851180 - DNA, 20 bp, mouse
gaacggttggccggctcaag

SEQ ID NO: 851181 - DNA, 20 bp, mouse
ggcggggcggagcctgacgg

SEQ ID NO: 851182 - DNA, 20 bp, mouse
ggatactagatactaggtta

SEQ ID NO: 851183 - DNA, 20 bp, mouse
gccgcacgtcacctcgaggg

SEQ ID NO: 851184 - DNA, 20 bp, mouse
gccccgcgatactagatact

SEQ ID NO: 851185 - DNA, 20 bp, mouse
gtcactgtgtttagtgatag

SEQ ID NO: 851186 - DNA, 20 bp, mouse
ggtgaacgtttgtagcttta

SEQ ID NO: 851187 - DNA, 20 bp, mouse
gttaggcagaagttaagggt

SEQ ID NO: 851188 - DNA, 20 bp, mouse
ggcgcatgcgcaacgggctc

SEQ ID NO: 851189 - DNA, 20 bp, mouse
gcagcggataaagagagatg

SEQ ID NO: 851190 - DNA, 20 bp, mouse
gctgggagagccgagcggaa

SEQ ID NO: 851191 - DNA, 20 bp, mouse
gaggtcagataactgggcgt

SEQ ID NO: 851192 - DNA, 20 bp, mouse
ggggtagggaagcaccaaaa

SEQ ID NO: 851193 - DNA, 20 bp, mouse
gaattttaggcagaagttaa

SEQ ID NO: 851194 - DNA, 20 bp, mouse
gggagagccgagcggaaggg

SEQ ID NO: 851195 - DNA, 20 bp, mouse
ggcggcggcgcatgcgcaac

SEQ ID NO: 851196 - DNA, 20 bp, mouse
gcaacatggcgccaggggtc

SEQ ID NO: 851197 - DNA, 20 bp, mouse
gcctgcgcgcgcccgctcac

SEQ ID NO: 851198 - DNA, 20 bp, mouse
gacacggccgggcctcccag

SEQ ID NO: 851199 - DNA, 20 bp, mouse
ggtcaggcgtgctcccgagg

SEQ ID NO: 851200 - DNA, 20 bp, mouse
gcgtgaggagaaagcagcag

SEQ ID NO: 851201 - DNA, 20 bp, mouse
gagctctgcgcggggtccgc

SEQ ID NO: 851202 - DNA, 20 bp, mouse
ggacagcagagcgcgagttc

SEQ ID NO: 851203 - DNA, 20 bp, mouse
gcgggagcacgcctgacccc

SEQ ID NO: 851204 - DNA, 20 bp, mouse
gccggcgcgggagctctgcg

SEQ ID NO: 851205 - DNA, 20 bp, mouse
gagcgcgagttccggtgagc

SEQ ID NO: 851206 - DNA, 20 bp, mouse
gtcaacttccgacagatagg

SEQ ID NO: 851207 - DNA, 20 bp, mouse
gtgttctcggattgactagt

SEQ ID NO: 851208 - DNA, 20 bp, mouse
gcagtccaagaggaatgcgg

SEQ ID NO: 851209 - DNA, 20 bp, mouse
gacaactccttctcacctat

SEQ ID NO: 851210 - DNA, 20 bp, mouse
gtaccagccaataggtgaga

SEQ ID NO: 851211 - DNA, 20 bp, mouse
gctgaccgacccaactagtc

SEQ ID NO: 851212 - DNA, 20 bp, mouse
gtgcggcgctaccagccaat

SEQ ID NO: 851213 - DNA, 20 bp, mouse
gacagcgcggccctgagccc

SEQ ID NO: 851214 - DNA, 20 bp, mouse
gagctccgccccctatctgt

SEQ ID NO: 851215 - DNA, 20 bp, mouse
gggacagcaccagttctgaa

SEQ ID NO: 851216 - DNA, 20 bp, mouse
ggggtctctcgatactactg

SEQ ID NO: 851217 - DNA, 20 bp, mouse
ggctgcgtaagtggcgtacg

SEQ ID NO: 851218 - DNA, 20 bp, mouse
ggggtgcagcctggttgagt

SEQ ID NO: 851219 - DNA, 20 bp, mouse
ggggcgtcggcttacataag

SEQ ID NO: 851220 - DNA, 20 bp, mouse
ggcggagcttggtgcgatct

SEQ ID NO: 851221 - DNA, 20 bp, mouse
gactgaggccaatgacgtaa

SEQ ID NO: 851222 - DNA, 20 bp, mouse
gcgtcggcttacataagagg

SEQ ID NO: 851223 - DNA, 20 bp, mouse
gagcctggttgagtgggcgt

SEQ ID NO: 851224 - DNA, 20 bp, mouse
ggcaccccctccagagggtg

SEQ ID NO: 851225 - DNA, 20 bp, mouse
gtgaaaggcggggagaatga

SEQ ID NO: 851226 - DNA, 20 bp, mouse
gcccggaagccggagatccg

SEQ ID NO: 851227 - DNA, 20 bp, mouse
gtaaagagacaggcgaagtg

SEQ ID NO: 851228 - DNA, 20 bp, mouse
gtcggtggtcttaaagagac

SEQ ID NO: 851229 - DNA, 20 bp, mouse
gcgaagtggggcgaattctc

SEQ ID NO: 851230 - DNA, 20 bp, mouse
gaccggagcgccaagtaact

SEQ ID NO: 851231 - DNA, 20 bp, mouse
gagcgaagactcggaaaacg

SEQ ID NO: 851232 - DNA, 20 bp, mouse
gctgagtcccgccctctcgg

SEQ ID NO: 851233 - DNA, 20 bp, mouse
gaaaacttaaccagcgagga

SEQ ID NO: 851234 - DNA, 20 bp, mouse
gaggaaggcaccatagcaga

SEQ ID NO: 851235 - DNA, 20 bp, mouse
ggtgctgagtcccgccctct

SEQ ID NO: 851236 - DNA, 20 bp, mouse
ggagtagaaacgcatagtgt

SEQ ID NO: 851237 - DNA, 20 bp, mouse
gccggtgggcacggtgaagc

SEQ ID NO: 851238 - DNA, 20 bp, mouse
gacaggaagtagtttcccac

SEQ ID NO: 851239 - DNA, 20 bp, mouse
gcagaaggctgcagggtggg

SEQ ID NO: 851240 - DNA, 20 bp, mouse
gtactcggctgaggaaccgc

SEQ ID NO: 851241 - DNA, 20 bp, mouse
ggacgcgactgagtgagtag

SEQ ID NO: 851242 - DNA, 20 bp, mouse
gccgcgcggccctgtacgtg

SEQ ID NO: 851243 - DNA, 20 bp, mouse
gtggcagaaggctgcagggt

SEQ ID NO: 851244 - DNA, 20 bp, mouse
ggtgtcggaatgaaaaaggc

SEQ ID NO: 851245 - DNA, 20 bp, mouse
gctgcgcaagcgcaagatac

SEQ ID NO: 851246 - DNA, 20 bp, mouse
gcgtctccgcagcaacgctc

SEQ ID NO: 851247 - DNA, 20 bp, mouse
ggacctagagccaacagaaa

SEQ ID NO: 851248 - DNA, 20 bp, mouse
gcggggcgcgggaaggatga

SEQ ID NO: 851249 - DNA, 20 bp, mouse
gatggcggcggctcaggcgg

SEQ ID NO: 851250 - DNA, 20 bp, mouse
ggggcggcacggggaagtag

SEQ ID NO: 851251 - DNA, 20 bp, mouse
gtcaggcggtggaggagatg

SEQ ID NO: 851252 - DNA, 20 bp, mouse
gggaaggatgagggcggcac

SEQ ID NO: 851253 - DNA, 20 bp, mouse
gtacagcgagtggcggaaga

SEQ ID NO: 851254 - DNA, 20 bp, mouse
gttccgccactcgctgtaaa

SEQ ID NO: 851255 - DNA, 20 bp, mouse
ggggagcccgagcgttgctg

SEQ ID NO: 851256 - DNA, 20 bp, mouse
ggccacttccggtgttggag

SEQ ID NO: 851257 - DNA, 20 bp, mouse
gggcggaacagagatttcag

SEQ ID NO: 851258 - DNA, 20 bp, mouse
gccccggcgtcgtggtgctt

SEQ ID NO: 851259 - DNA, 20 bp, mouse
gcccgcgagaagattctgat

SEQ ID NO: 851260 - DNA, 20 bp, mouse
gacgacgccggggccctgac

SEQ ID NO: 851261 - DNA, 20 bp, mouse
gaccactccaacaccggaag

SEQ ID NO: 851262 - DNA, 20 bp, mouse
gtgagagcttagtcgtttga

SEQ ID NO: 851263 - DNA, 20 bp, mouse
gcacccaagcaccacgacgc

SEQ ID NO: 851264 - DNA, 20 bp, mouse
gccggaaaccactccaacac

SEQ ID NO: 851265 - DNA, 20 bp, mouse
gtacaaacagccaatcccgg

SEQ ID NO: 851266 - DNA, 20 bp, mouse
ggagtgcgcaagcggatcag

SEQ ID NO: 851267 - DNA, 20 bp, mouse
ggtcctgtagcgagccaata

SEQ ID NO: 851268 - DNA, 20 bp, mouse
gccggcagccgggttaacag

SEQ ID NO: 851269 - DNA, 20 bp, mouse
ggtagcgagccaatagggaa

SEQ ID NO: 851270 - DNA, 20 bp, mouse
gcaaccgggccgcgcgaaac

SEQ ID NO: 851271 - DNA, 20 bp, mouse
gcccgcctccactgttaacc

SEQ ID NO: 851272 - DNA, 20 bp, mouse
gggaggcgggagtgcgcaag

SEQ ID NO: 851273 - DNA, 20 bp, mouse
gcaggttccccgttccctat

SEQ ID NO: 851274 - DNA, 20 bp, mouse
gggaacggggaacctgcttc

SEQ ID NO: 851275 - DNA, 20 bp, mouse
gtctacgtcccgcccccacc

SEQ ID NO: 851276 - DNA, 20 bp, mouse
gtggggacgcagtttcgcta

SEQ ID NO: 851277 - DNA, 20 bp, mouse
gctaccggagcaccggaact

SEQ ID NO: 851278 - DNA, 20 bp, mouse
ggcggcgcccagccgagttc

SEQ ID NO: 851279 - DNA, 20 bp, mouse
ggctcgcgctcgagcctcgg

SEQ ID NO: 851280 - DNA, 20 bp, mouse
gtctcagtgggcgtggaagg

SEQ ID NO: 851281 - DNA, 20 bp, mouse
gggtgctccggtagcctccg

SEQ ID NO: 851282 - DNA, 20 bp, mouse
gtctagcctgcactctcagt

SEQ ID NO: 851283 - DNA, 20 bp, mouse
gcactctcagtgggcgtgga

SEQ ID NO: 851284 - DNA, 20 bp, mouse
gaccgcgcgctgaccagccc

SEQ ID NO: 851285 - DNA, 20 bp, mouse
gaaacctgagacgtggagac

SEQ ID NO: 851286 - DNA, 20 bp, mouse
ggggtgaaaagatgacgcac

SEQ ID NO: 851287 - DNA, 20 bp, mouse
gcaacatgcagacatgaata

SEQ ID NO: 851288 - DNA, 20 bp, mouse
gctaggctgaaaaccacagt

SEQ ID NO: 851289 - DNA, 20 bp, mouse
gcaatccagggagagagcat

SEQ ID NO: 851290 - DNA, 20 bp, mouse
gaatctgtcctctgacacgg

SEQ ID NO: 851291 - DNA, 20 bp, mouse
gtgttataagatactgtgtt

SEQ ID NO: 851292 - DNA, 20 bp, mouse
gcatctgtccaccgtgtcag

SEQ ID NO: 851293 - DNA, 20 bp, mouse
ggtttagtgggcatgcacac

SEQ ID NO: 851294 - DNA, 20 bp, mouse
gtatttattggaagcaatcc

SEQ ID NO: 851295 - DNA, 20 bp, mouse
gagctgcagaaattaaaagc

SEQ ID NO: 851296 - DNA, 20 bp, mouse
gggggaaatcaaatacgata

SEQ ID NO: 851297 - DNA, 20 bp, mouse
ggggtctcgggtcacagtac

SEQ ID NO: 851298 - DNA, 20 bp, mouse
gaaatacgatagggatgtgg

SEQ ID NO: 851299 - DNA, 20 bp, mouse
gaagatgtctcaggtcggag

SEQ ID NO: 851300 - DNA, 20 bp, mouse
gcctctcgtggggactgcgt

SEQ ID NO: 851301 - DNA, 20 bp, mouse
gcgggtcacagtacagggtg

SEQ ID NO: 851302 - DNA, 20 bp, mouse
gctgaggtcagacccgaggt

SEQ ID NO: 851303 - DNA, 20 bp, mouse
gaacaaaagtaccacgaggt

SEQ ID NO: 851304 - DNA, 20 bp, mouse
ggggtggggtagagaggctg

SEQ ID NO: 851305 - DNA, 20 bp, mouse
ggtcagacccgaggtgggtg

SEQ ID NO: 851306 - DNA, 20 bp, mouse
gtccgcgcgacagcccggaa

SEQ ID NO: 851307 - DNA, 20 bp, mouse
gcggaccctggctgccggtg

SEQ ID NO: 851308 - DNA, 20 bp, mouse
gcgcccgcgtccgcccgggt

SEQ ID NO: 851309 - DNA, 20 bp, mouse
gcggaagggaacctgcgcca

SEQ ID NO: 851310 - DNA, 20 bp, mouse
gcacgcgcgtaccctgcctt

SEQ ID NO: 851311 - DNA, 20 bp, mouse
gcgccaaggcactgccacgc

SEQ ID NO: 851312 - DNA, 20 bp, mouse
gcactccccaccggcagcca

SEQ ID NO: 851313 - DNA, 20 bp, mouse
gtatagagtggggacagcta

SEQ ID NO: 851314 - DNA, 20 bp, mouse
gctcctggcgccgacccggg

SEQ ID NO: 851315 - DNA, 20 bp, mouse
gtgctccagccgctcctcgg

SEQ ID NO: 851316 - DNA, 20 bp, mouse
gcatgcgcagtaccatcgag

SEQ ID NO: 851317 - DNA, 20 bp, mouse
ggagaacaaaggccagatag

SEQ ID NO: 851318 - DNA, 20 bp, mouse
gaccatcgagcggagaacaa

SEQ ID NO: 851319 - DNA, 20 bp, mouse
gacagcgagtacctgcgcca

SEQ ID NO: 851320 - DNA, 20 bp, mouse
ggctgttgccgccttccttc

SEQ ID NO: 851321 - DNA, 20 bp, mouse
gaggccgcggagcgtgtgaa

SEQ ID NO: 851322 - DNA, 20 bp, mouse
gcctgacaggggacaatgat

SEQ ID NO: 851323 - DNA, 20 bp, mouse
gatagagggaaccttggcgc

SEQ ID NO: 851324 - DNA, 20 bp, mouse
ggggcccagctccgtagcgc

SEQ ID NO: 851325 - DNA, 20 bp, mouse
ggctgggcccgcggtcggga

SEQ ID NO: 851326 - DNA, 20 bp, mouse
gctagcgaagccacagaatg

SEQ ID NO: 851327 - DNA, 20 bp, mouse
gccaggctctccacattctg

SEQ ID NO: 851328 - DNA, 20 bp, mouse
gtaagcaggcatcgacgggt

SEQ ID NO: 851329 - DNA, 20 bp, mouse
gctgccggctccctgtaagc

SEQ ID NO: 851330 - DNA, 20 bp, mouse
gcactgctgggcgcagtctg

SEQ ID NO: 851331 - DNA, 20 bp, mouse
gccctgtaagcaggcatcga

SEQ ID NO: 851332 - DNA, 20 bp, mouse
gtctagctcatgcggaggga

SEQ ID NO: 851333 - DNA, 20 bp, mouse
gaaaacagcccgtgtatccg

SEQ ID NO: 851334 - DNA, 20 bp, mouse
gtgaacgcggaggcttgctc

SEQ ID NO: 851335 - DNA, 20 bp, mouse
gacagagtccccggaagagg

SEQ ID NO: 851336 - DNA, 20 bp, mouse
ggcagagccgactcatcgtc

SEQ ID NO: 851337 - DNA, 20 bp, mouse
gcagccacgaaccccgccag

SEQ ID NO: 851338 - DNA, 20 bp, mouse
gagccgactcatcgtcggga

SEQ ID NO: 851339 - DNA, 20 bp, mouse
ggctctgcctggtgtttggg

SEQ ID NO: 851340 - DNA, 20 bp, mouse
gtgagccctgccaccaaccg

SEQ ID NO: 851341 - DNA, 20 bp, mouse
gacgccgctggcggggttcg

SEQ ID NO: 851342 - DNA, 20 bp, mouse
ggggctacagagttggaaac

SEQ ID NO: 851343 - DNA, 20 bp, mouse
ggcgccgaactgattcattg

SEQ ID NO: 851344 - DNA, 20 bp, mouse
ggggatacgaggaatcggac

SEQ ID NO: 851345 - DNA, 20 bp, mouse
gagcggcgtgactgtttggt

SEQ ID NO: 851346 - DNA, 20 bp, mouse
ggacgcgtggggcagggcga

SEQ ID NO: 851347 - DNA, 20 bp, mouse
gcgggtggacgcgtggggca

SEQ ID NO: 851348 - DNA, 20 bp, mouse
ggggcgcgggtggacgcgtg

SEQ ID NO: 851349 - DNA, 20 bp, mouse
ggggctggaacgtgtccggg

SEQ ID NO: 851350 - DNA, 20 bp, mouse
ggactgggctggaacgtgtc

SEQ ID NO: 851351 - DNA, 20 bp, mouse
gagctcgccaggagtccggt

SEQ ID NO: 851352 - DNA, 20 bp, mouse
gaaccggcaggtcgcggggc

SEQ ID NO: 851353 - DNA, 20 bp, mouse
gcggcgggaacgcgagggcg

SEQ ID NO: 851354 - DNA, 20 bp, mouse
ggtggagctcgccaggagtc

SEQ ID NO: 851355 - DNA, 20 bp, mouse
gccgctgcgctcgggggact

SEQ ID NO: 851356 - DNA, 20 bp, mouse
gccccgccagggccgagggg

SEQ ID NO: 851357 - DNA, 20 bp, mouse
gcgcgccccgccagggccga

SEQ ID NO: 851358 - DNA, 20 bp, mouse
gcggccgcagcccatccgcc

SEQ ID NO: 851359 - DNA, 20 bp, mouse
ggccgtgcagggccaaccag

SEQ ID NO: 851360 - DNA, 20 bp, mouse
ggcccccgcgcctatcccat

SEQ ID NO: 851361 - DNA, 20 bp, mouse
ggccaggagccaatcactgg

SEQ ID NO: 851362 - DNA, 20 bp, mouse
gcaagcccccagcccggatt

SEQ ID NO: 851363 - DNA, 20 bp, mouse
gtcgcacgcgcgccccgcca

SEQ ID NO: 851364 - DNA, 20 bp, mouse
ggctcctggcggatgggctg

SEQ ID NO: 851365 - DNA, 20 bp, mouse
gcccccagcccggattcgga

SEQ ID NO: 851366 - DNA, 20 bp, mouse
gggagcgcctcatgcaaatg

SEQ ID NO: 851367 - DNA, 20 bp, mouse
ggccgtctcgcccggaaatg

SEQ ID NO: 851368 - DNA, 20 bp, mouse
gcacgcccgggttagcctct

SEQ ID NO: 851369 - DNA, 20 bp, mouse
gtagcgggagcccggagcag

SEQ ID NO: 851370 - DNA, 20 bp, mouse
gctaacccagaggctaaccc

SEQ ID NO: 851371 - DNA, 20 bp, mouse
gtccgggcgagacggctagc

SEQ ID NO: 851372 - DNA, 20 bp, mouse
gcaagtcgtagccgcatttc

SEQ ID NO: 851373 - DNA, 20 bp, mouse
gcagaggtgcaatcacgccc

SEQ ID NO: 851374 - DNA, 20 bp, mouse
ggagggggcgcgtcatacgg

SEQ ID NO: 851375 - DNA, 20 bp, mouse
gcgagatagcagagcagcag

SEQ ID NO: 851376 - DNA, 20 bp, mouse
gggctagaggggtgatgtta

SEQ ID NO: 851377 - DNA, 20 bp, mouse
gcagagagatggctggcata

SEQ ID NO: 851378 - DNA, 20 bp, mouse
gaggggtgatgttagggagt

SEQ ID NO: 851379 - DNA, 20 bp, mouse
gggcataggggtgtcgatgt

SEQ ID NO: 851380 - DNA, 20 bp, mouse
gacacaggaggcgggttgag

SEQ ID NO: 851381 - DNA, 20 bp, mouse
gggtaaggaaaaggagaaat

SEQ ID NO: 851382 - DNA, 20 bp, mouse
gataggggtgtcgatgtagg

SEQ ID NO: 851383 - DNA, 20 bp, mouse
gcacctcccacgtcagagca

SEQ ID NO: 851384 - DNA, 20 bp, mouse
gatcaagggaccaggctaga

SEQ ID NO: 851385 - DNA, 20 bp, mouse
ggggcaggcatcaagggacc

SEQ ID NO: 851386 - DNA, 20 bp, mouse
ggggcggggcccggcggaag

SEQ ID NO: 851387 - DNA, 20 bp, mouse
gcggaaggggcagagtgcca

SEQ ID NO: 851388 - DNA, 20 bp, mouse
ggggagggcgagcccgagaa

SEQ ID NO: 851389 - DNA, 20 bp, mouse
gtgtaagcgggcaagggtgg

SEQ ID NO: 851390 - DNA, 20 bp, mouse
ggcggagtgtaagcgggcaa

SEQ ID NO: 851391 - DNA, 20 bp, mouse
gggagtccgcccatccgctg

SEQ ID NO: 851392 - DNA, 20 bp, mouse
ggggcggagcctagaaatga

SEQ ID NO: 851393 - DNA, 20 bp, mouse
ggtgggcggcggagtgtaag

SEQ ID NO: 851394 - DNA, 20 bp, mouse
ggcactctgccccttccgcc

SEQ ID NO: 851395 - DNA, 20 bp, mouse
gccccgaagccgcagcggat

SEQ ID NO: 851396 - DNA, 20 bp, mouse
gactgcggaggggtggtgag

SEQ ID NO: 851397 - DNA, 20 bp, mouse
ggcgacttgaaggagaacgg

SEQ ID NO: 851398 - DNA, 20 bp, mouse
gtaaagggaccgcgaccccc

SEQ ID NO: 851399 - DNA, 20 bp, mouse
gcggggggcggactgcggag

SEQ ID NO: 851400 - DNA, 20 bp, mouse
gcggcgcggggggcggactg

SEQ ID NO: 851401 - DNA, 20 bp, mouse
gcggaggggtggtgagcggg

SEQ ID NO: 851402 - DNA, 20 bp, mouse
ggggtcgcggtccctttaag

SEQ ID NO: 851403 - DNA, 20 bp, mouse
gcgggtggcacgggcggcga

SEQ ID NO: 851404 - DNA, 20 bp, mouse
gtccgctcccggccgcttaa

SEQ ID NO: 851405 - DNA, 20 bp, mouse
gggggcggactgcggagggg

SEQ ID NO: 851406 - DNA, 20 bp, mouse
ggcgagaagcgggacgtaag

SEQ ID NO: 851407 - DNA, 20 bp, mouse
gacagtgcggggaaccgggg

SEQ ID NO: 851408 - DNA, 20 bp, mouse
gggaaccgccctcgttccag

SEQ ID NO: 851409 - DNA, 20 bp, mouse
gcgcgcaaacttgacgtcca

SEQ ID NO: 851410 - DNA, 20 bp, mouse
gggggactggagcgagaagc

SEQ ID NO: 851411 - DNA, 20 bp, mouse
ggtcacagtgcggggaaccg

SEQ ID NO: 851412 - DNA, 20 bp, mouse
gtcgcggaacgtcacagtgc

SEQ ID NO: 851413 - DNA, 20 bp, mouse
gttatcctctggaacgaggg

SEQ ID NO: 851414 - DNA, 20 bp, mouse
gtcaagtttgcgcgcggggc

SEQ ID NO: 851415 - DNA, 20 bp, mouse
ggcgcaaggcatttcgggag

SEQ ID NO: 851416 - DNA, 20 bp, mouse
gcgcccgcccgcagcttctc

SEQ ID NO: 851417 - DNA, 20 bp, mouse
gtggggaatgcggtccttgg

SEQ ID NO: 851418 - DNA, 20 bp, mouse
gggtgctgcgctggggaatg

SEQ ID NO: 851419 - DNA, 20 bp, mouse
gccaaagcctcggggtcgtg

SEQ ID NO: 851420 - DNA, 20 bp, mouse
gccagcgctcccgcgttctg

SEQ ID NO: 851421 - DNA, 20 bp, mouse
gcgctggggaatgcggtcct

SEQ ID NO: 851422 - DNA, 20 bp, mouse
ggcgcgcgaccccagaacgc

SEQ ID NO: 851423 - DNA, 20 bp, mouse
ggcgcgtgatgacgtcacga

SEQ ID NO: 851424 - DNA, 20 bp, mouse
gttggagaaccaaagcctcg

SEQ ID NO: 851425 - DNA, 20 bp, mouse
gggctgtgcgggtgctgcgc

SEQ ID NO: 851426 - DNA, 20 bp, mouse
gggcgactcgagagtcacgt

SEQ ID NO: 851427 - DNA, 20 bp, mouse
ggggcgggaccggaccggat

SEQ ID NO: 851428 - DNA, 20 bp, mouse
gggaccggaccggatggggc

SEQ ID NO: 851429 - DNA, 20 bp, mouse
gtcctggggcggcgcctatt

SEQ ID NO: 851430 - DNA, 20 bp, mouse
gcgccccgccccatccggtc

SEQ ID NO: 851431 - DNA, 20 bp, mouse
ggcggcgcctattggggaga

SEQ ID NO: 851432 - DNA, 20 bp, mouse
gaatcctgggcgaggagcga

SEQ ID NO: 851433 - DNA, 20 bp, mouse
gcgacggtgcgcaggcgcaa

SEQ ID NO: 851434 - DNA, 20 bp, mouse
gagtctcgcgctggaggggc

SEQ ID NO: 851435 - DNA, 20 bp, mouse
gctattggggagacggtgtg

SEQ ID NO: 851436 - DNA, 20 bp, mouse
ggcccggcgcgaagcatctc

SEQ ID NO: 851437 - DNA, 20 bp, mouse
ggcgccgggcccttccgcgt

SEQ ID NO: 851438 - DNA, 20 bp, mouse
gcgctccggagcatagagac

SEQ ID NO: 851439 - DNA, 20 bp, mouse
gggcgcgaagcatctcggga

SEQ ID NO: 851440 - DNA, 20 bp, mouse
gcctaggcccaaagcggcgg

SEQ ID NO: 851441 - DNA, 20 bp, mouse
ggctcctaggcccaaagcgg

SEQ ID NO: 851442 - DNA, 20 bp, mouse
ggggggaggccgagcggcag

SEQ ID NO: 851443 - DNA, 20 bp, mouse
ggtcgctgacccacgcggaa

SEQ ID NO: 851444 - DNA, 20 bp, mouse
gtcacagtcgctgacccacg

SEQ ID NO: 851445 - DNA, 20 bp, mouse
gtgggctggaggagcggaag

SEQ ID NO: 851446 - DNA, 20 bp, mouse
gcccccgccgtgcacgtcat

SEQ ID NO: 851447 - DNA, 20 bp, mouse
gcacgtcatcggagagggga

SEQ ID NO: 851448 - DNA, 20 bp, mouse
gacggcccggagcggaagtg

SEQ ID NO: 851449 - DNA, 20 bp, mouse
gcgcccgagcccaacgctca

SEQ ID NO: 851450 - DNA, 20 bp, mouse
gcgtgcacgtcatcggagag

SEQ ID NO: 851451 - DNA, 20 bp, mouse
gaggaactgcgaggtgtgcg

SEQ ID NO: 851452 - DNA, 20 bp, mouse
gcgcacgcacgcacgcccgg

SEQ ID NO: 851453 - DNA, 20 bp, mouse
gacgcacgcacgcccggtgg

SEQ ID NO: 851454 - DNA, 20 bp, mouse
gtggacgtcagactggatag

SEQ ID NO: 851455 - DNA, 20 bp, mouse
gcggagcccgaggccgtggc

SEQ ID NO: 851456 - DNA, 20 bp, mouse
gaccaagagggagcggtcgt

SEQ ID NO: 851457 - DNA, 20 bp, mouse
gaacagggcgggctccggga

SEQ ID NO: 851458 - DNA, 20 bp, mouse
gcggtgatagccaggaggag

SEQ ID NO: 851459 - DNA, 20 bp, mouse
gtgctccgtcctcctgaaaa

SEQ ID NO: 851460 - DNA, 20 bp, mouse
ggaaaagggcggtgatagcc

SEQ ID NO: 851461 - DNA, 20 bp, mouse
gagcctgggtgggagcgagg

SEQ ID NO: 851462 - DNA, 20 bp, mouse
ggctgggatgtgtgagaaca

SEQ ID NO: 851463 - DNA, 20 bp, mouse
gaagagggagcggtcgtggg

SEQ ID NO: 851464 - DNA, 20 bp, mouse
gagggggcggacgcagggaa

SEQ ID NO: 851465 - DNA, 20 bp, mouse
gcgaggagggggcggacgca

SEQ ID NO: 851466 - DNA, 20 bp, mouse
gccgcccgctgtgccgacgg

SEQ ID NO: 851467 - DNA, 20 bp, mouse
ggcaaccgctccctggcaac

SEQ ID NO: 851468 - DNA, 20 bp, mouse
gccgctgtgccgacggagga

SEQ ID NO: 851469 - DNA, 20 bp, mouse
gacagacgcccctcctccgt

SEQ ID NO: 851470 - DNA, 20 bp, mouse
gccccccgcgccagttgcca

SEQ ID NO: 851471 - DNA, 20 bp, mouse
ggctccctggcaactggcgc

SEQ ID NO: 851472 - DNA, 20 bp, mouse
ggggcggccctgtggcgagg

SEQ ID NO: 851473 - DNA, 20 bp, mouse
gcggagttcggcgccagaaa

SEQ ID NO: 851474 - DNA, 20 bp, mouse
gtctgcgcgacggatggaag

SEQ ID NO: 851475 - DNA, 20 bp, mouse
gtcggcctagactgcgggag

SEQ ID NO: 851476 - DNA, 20 bp, mouse
gagggagcagtgtagtactg

SEQ ID NO: 851477 - DNA, 20 bp, mouse
gtgaagaaaggggcacatta

SEQ ID NO: 851478 - DNA, 20 bp, mouse
gtacggtaaagtgaagaaag

SEQ ID NO: 851479 - DNA, 20 bp, mouse
gtctactggaacattcgcgg

SEQ ID NO: 851480 - DNA, 20 bp, mouse
gtactgggcttctcttctac

SEQ ID NO: 851481 - DNA, 20 bp, mouse
gcgtgtgggcgggaccgcag

SEQ ID NO: 851482 - DNA, 20 bp, mouse
gggcgcgcgcatgcgcgagt

SEQ ID NO: 851483 - DNA, 20 bp, mouse
gcctgcgcgcaatgcccact

SEQ ID NO: 851484 - DNA, 20 bp, mouse
gagcccagtaaatgcaggac

SEQ ID NO: 851485 - DNA, 20 bp, mouse
ggcccggtcctgcatttact

SEQ ID NO: 851486 - DNA, 20 bp, mouse
gagcccgccgagctacggga

SEQ ID NO: 851487 - DNA, 20 bp, mouse
ggtaaactgcagtactccta

SEQ ID NO: 851488 - DNA, 20 bp, mouse
gccaccctccaacgctgcgg

SEQ ID NO: 851489 - DNA, 20 bp, mouse
gagccctaacggtcttttta

SEQ ID NO: 851490 - DNA, 20 bp, mouse
gcaagcccgagctctatcat

SEQ ID NO: 851491 - DNA, 20 bp, mouse
gcctgcgcagctctccagcg

SEQ ID NO: 851492 - DNA, 20 bp, mouse
gcaccttaaaaagaccgtta

SEQ ID NO: 851493 - DNA, 20 bp, mouse
ggccccctcccgtagctcgg

SEQ ID NO: 851494 - DNA, 20 bp, mouse
gttaccgccgcagcgttgga

SEQ ID NO: 851495 - DNA, 20 bp, mouse
ggccgcggcgagggccgcgc

SEQ ID NO: 851496 - DNA, 20 bp, mouse
ggaggggcgagcgcgcggaa

SEQ ID NO: 851497 - DNA, 20 bp, mouse
gggggcgggaagcgaagcgg

SEQ ID NO: 851498 - DNA, 20 bp, mouse
gaagcgaagcggaggctccg

SEQ ID NO: 851499 - DNA, 20 bp, mouse
gggcggggcgggaagcgaag

SEQ ID NO: 851500 - DNA, 20 bp, mouse
ggggtcggctcgggtaggtt

SEQ ID NO: 851501 - DNA, 20 bp, mouse
gctcgcccctcattggacag

SEQ ID NO: 851502 - DNA, 20 bp, mouse
gggaggctccgagggtgggt

SEQ ID NO: 851503 - DNA, 20 bp, mouse
ggaagcggaggctccgaggg

SEQ ID NO: 851504 - DNA, 20 bp, mouse
gcgcgcggaagggggcccag

SEQ ID NO: 851505 - DNA, 20 bp, mouse
gccgcgcgctcgcccctcat

SEQ ID NO: 851506 - DNA, 20 bp, mouse
gccggcccgcccgtgcccga

SEQ ID NO: 851507 - DNA, 20 bp, mouse
ggagcacgcgggtgaaggca

SEQ ID NO: 851508 - DNA, 20 bp, mouse
ggcgccgggccggagaactg

SEQ ID NO: 851509 - DNA, 20 bp, mouse
gtcctccgcccggaaagggg

SEQ ID NO: 851510 - DNA, 20 bp, mouse
ggggagcgaaccgagcacgc

SEQ ID NO: 851511 - DNA, 20 bp, mouse
ggaaccgagcacgcgggtga

SEQ ID NO: 851512 - DNA, 20 bp, mouse
gatgtgcccgccagtgaggt

SEQ ID NO: 851513 - DNA, 20 bp, mouse
ggggagggagggcagctcgc

SEQ ID NO: 851514 - DNA, 20 bp, mouse
gaactgtgggcaccaatcaa

SEQ ID NO: 851515 - DNA, 20 bp, mouse
gcacaccgaactgttgtcgt

SEQ ID NO: 851516 - DNA, 20 bp, mouse
gcgcggggcgcaccgatctc

SEQ ID NO: 851517 - DNA, 20 bp, mouse
gggggcgcaccgatctcggg

SEQ ID NO: 851518 - DNA, 20 bp, mouse
gagagccggaacagcgagtg

SEQ ID NO: 851519 - DNA, 20 bp, mouse
gcctcgaggggccctgcgat

SEQ ID NO: 851520 - DNA, 20 bp, mouse
gggaacagcgagtggggaat

SEQ ID NO: 851521 - DNA, 20 bp, mouse
gaagtctcgcgaggccgagc

SEQ ID NO: 851522 - DNA, 20 bp, mouse
gacgccccctaccccagcgg

SEQ ID NO: 851523 - DNA, 20 bp, mouse
gcggggccccggcgcctcga

SEQ ID NO: 851524 - DNA, 20 bp, mouse
ggccctgcgattggtagcga

SEQ ID NO: 851525 - DNA, 20 bp, mouse
ggaggaccctggttgggagt

SEQ ID NO: 851526 - DNA, 20 bp, mouse
gggaaggtgtgcaatcaaaa

SEQ ID NO: 851527 - DNA, 20 bp, mouse
gtaaaatagcaggaaaccca

SEQ ID NO: 851528 - DNA, 20 bp, mouse
gtagctcagagataggataa

SEQ ID NO: 851529 - DNA, 20 bp, mouse
ggagttgcagaaccttccct

SEQ ID NO: 851530 - DNA, 20 bp, mouse
gttctgcaactcctgaagga

SEQ ID NO: 851531 - DNA, 20 bp, mouse
gcatgcgttgaacgtgtcac

SEQ ID NO: 851532 - DNA, 20 bp, mouse
gaaggttctgcaactcctga

SEQ ID NO: 851533 - DNA, 20 bp, mouse
ggcaaaagaagctttcttgc

SEQ ID NO: 851534 - DNA, 20 bp, mouse
gatagcaggaaacccaggga

SEQ ID NO: 851535 - DNA, 20 bp, mouse
gtcactaaactgcgacagac

SEQ ID NO: 851536 - DNA, 20 bp, mouse
ggcaggggacagaaatacgt

SEQ ID NO: 851537 - DNA, 20 bp, mouse
gcacggcaatatcgtaatgg

SEQ ID NO: 851538 - DNA, 20 bp, mouse
gatgcacggcaatatcgtaa

SEQ ID NO: 851539 - DNA, 20 bp, mouse
ggatagaaatgctacgtatg

SEQ ID NO: 851540 - DNA, 20 bp, mouse
ggggacagaaatacgtagga

SEQ ID NO: 851541 - DNA, 20 bp, mouse
gacgtgattaatttaaatgt

SEQ ID NO: 851542 - DNA, 20 bp, mouse
gaggcctcatttgttcattt

SEQ ID NO: 851543 - DNA, 20 bp, mouse
ggaaatgctacgtatggggc

SEQ ID NO: 851544 - DNA, 20 bp, mouse
gttctgacaatcccaaactc

SEQ ID NO: 851545 - DNA, 20 bp, mouse
gtgagtcacaagcacgctgc

SEQ ID NO: 851546 - DNA, 20 bp, mouse
ggtgaacaacccagttctgt

SEQ ID NO: 851547 - DNA, 20 bp, mouse
gaactgggttgttcacctgc

SEQ ID NO: 851548 - DNA, 20 bp, mouse
ggataaacatcactgtgaaa

SEQ ID NO: 851549 - DNA, 20 bp, mouse
gaaagtgcgagttttccatg

SEQ ID NO: 851550 - DNA, 20 bp, mouse
gcaggctaacattgcgtgct

SEQ ID NO: 851551 - DNA, 20 bp, mouse
gtcacagtcaggataccagc

SEQ ID NO: 851552 - DNA, 20 bp, mouse
ggactgtgattccttgaagt

SEQ ID NO: 851553 - DNA, 20 bp, mouse
gagagctcctgggatcgcag

SEQ ID NO: 851554 - DNA, 20 bp, mouse
ggtagcaggcagggtcacca

SEQ ID NO: 851555 - DNA, 20 bp, mouse
gatatgctgcgtagcaggca

SEQ ID NO: 851556 - DNA, 20 bp, mouse
gaggggagggcgggagccta

SEQ ID NO: 851557 - DNA, 20 bp, mouse
gggcgggagccaggcggcga

SEQ ID NO: 851558 - DNA, 20 bp, mouse
gttgccgctcggggacgctt

SEQ ID NO: 851559 - DNA, 20 bp, mouse
gccggcccgcgccctcccct

SEQ ID NO: 851560 - DNA, 20 bp, mouse
gaacccgggcgcgccacccc

SEQ ID NO: 851561 - DNA, 20 bp, mouse
gcccggaggaaaggggaggg

SEQ ID NO: 851562 - DNA, 20 bp, mouse
gcggagggtggggatatccg

SEQ ID NO: 851563 - DNA, 20 bp, mouse
gggagggcggaggaaatcct

SEQ ID NO: 851564 - DNA, 20 bp, mouse
gcctccgcacgctctgcgaa

SEQ ID NO: 851565 - DNA, 20 bp, mouse
gtggcgcgcccgggttccgc

SEQ ID NO: 851566 - DNA, 20 bp, mouse
gagactgaatgcacttggct

SEQ ID NO: 851567 - DNA, 20 bp, mouse
gcagtctcacggggggtaag

SEQ ID NO: 851568 - DNA, 20 bp, mouse
gagcagggaaggcaatgtca

SEQ ID NO: 851569 - DNA, 20 bp, mouse
gaaggcaatgtcagggtcgc

SEQ ID NO: 851570 - DNA, 20 bp, mouse
gtctccgcgcggcgccaatg

SEQ ID NO: 851571 - DNA, 20 bp, mouse
gtctcacggggggtaagggg

SEQ ID NO: 851572 - DNA, 20 bp, mouse
gtgatcggggaggatgtaga

SEQ ID NO: 851573 - DNA, 20 bp, mouse
gtccctgctgggcaccgagc

SEQ ID NO: 851574 - DNA, 20 bp, mouse
gcctcagtgggaccatcaac

SEQ ID NO: 851575 - DNA, 20 bp, mouse
gccgtgagactgaatgcact

SEQ ID NO: 851576 - DNA, 20 bp, mouse
gggaagaaatgcaagtggcc

SEQ ID NO: 851577 - DNA, 20 bp, mouse
gacatgaatggctggaaatg

SEQ ID NO: 851578 - DNA, 20 bp, mouse
gctagctgcagaatgctgat

SEQ ID NO: 851579 - DNA, 20 bp, mouse
gacacactttcaatgcttcc

SEQ ID NO: 851580 - DNA, 20 bp, mouse
gtgagagtcacatgaatggc

SEQ ID NO: 851581 - DNA, 20 bp, mouse
gaaagtgtgtatgtggagcc

SEQ ID NO: 851582 - DNA, 20 bp, mouse
gctgttgagagtcacatgaa

SEQ ID NO: 851583 - DNA, 20 bp, mouse
gaggacttacttactcagag

SEQ ID NO: 851584 - DNA, 20 bp, mouse
gttaaaggcgtcaccatgcc

SEQ ID NO: 851585 - DNA, 20 bp, mouse
gagcattgaaagtgtgtatg

SEQ ID NO: 851586 - DNA, 20 bp, mouse
gtgtcgggaacacaagagga

SEQ ID NO: 851587 - DNA, 20 bp, mouse
ggtaccagccgcagggtgtc

SEQ ID NO: 851588 - DNA, 20 bp, mouse
ggcggggcagagcacatttc

SEQ ID NO: 851589 - DNA, 20 bp, mouse
ggtggggattgtagcagcca

SEQ ID NO: 851590 - DNA, 20 bp, mouse
gggaagggcaagttctggaa

SEQ ID NO: 851591 - DNA, 20 bp, mouse
gaggtgcccccctcaggtgg

SEQ ID NO: 851592 - DNA, 20 bp, mouse
gcagccagggattggggcaa

SEQ ID NO: 851593 - DNA, 20 bp, mouse
gcagcctttgccccaatccc

SEQ ID NO: 851594 - DNA, 20 bp, mouse
gcactccaggtgcccccctc

SEQ ID NO: 851595 - DNA, 20 bp, mouse
gaggccacatgctcctggcg

SEQ ID NO: 851596 - DNA, 20 bp, mouse
gagccacagcaaggatttgt

SEQ ID NO: 851597 - DNA, 20 bp, mouse
gtctgcatccacgagggagt

SEQ ID NO: 851598 - DNA, 20 bp, mouse
gtctttttctgcatccacga

SEQ ID NO: 851599 - DNA, 20 bp, mouse
gattagggagcaaaatacca

SEQ ID NO: 851600 - DNA, 20 bp, mouse
gttccttgctagccacagca

SEQ ID NO: 851601 - DNA, 20 bp, mouse
ggggaaggttttgctcctca

SEQ ID NO: 851602 - DNA, 20 bp, mouse
gccacgctgcgttaaatagg

SEQ ID NO: 851603 - DNA, 20 bp, mouse
gggagcaaaataccaaggtt

SEQ ID NO: 851604 - DNA, 20 bp, mouse
gcagagcagtctcctaacct

SEQ ID NO: 851605 - DNA, 20 bp, mouse
gtgctcctcatggcaacagc

SEQ ID NO: 851606 - DNA, 20 bp, mouse
gtgagcactgctgattggaa

SEQ ID NO: 851607 - DNA, 20 bp, mouse
gactgctgattggaaaggta

SEQ ID NO: 851608 - DNA, 20 bp, mouse
gtaactggctgctcccgctc

SEQ ID NO: 851609 - DNA, 20 bp, mouse
gttgttgatctggtatcagt

SEQ ID NO: 851610 - DNA, 20 bp, mouse
gaaacaattagtcatctcct

SEQ ID NO: 851611 - DNA, 20 bp, mouse
gccgaatcaaatctacaaag

SEQ ID NO: 851612 - DNA, 20 bp, mouse
gtaaattagtataggtatta

SEQ ID NO: 851613 - DNA, 20 bp, mouse
gagccaattgctaattcttg

SEQ ID NO: 851614 - DNA, 20 bp, mouse
gggtgacgactttgttgatc

SEQ ID NO: 851615 - DNA, 20 bp, mouse
gtggaataaattaagaaacc

SEQ ID NO: 851616 - DNA, 20 bp, mouse
gagtaaatgtagatcaaccc

SEQ ID NO: 851617 - DNA, 20 bp, mouse
ggtaaccaaggagaccaagg

SEQ ID NO: 851618 - DNA, 20 bp, mouse
gtccctctgcaggtggaaag

SEQ ID NO: 851619 - DNA, 20 bp, mouse
gtgtagatcaacccaggctg

SEQ ID NO: 851620 - DNA, 20 bp, mouse
ggtgtcgagcccaagcattc

SEQ ID NO: 851621 - DNA, 20 bp, mouse
gcaacaggtgtgtgttcagg

SEQ ID NO: 851622 - DNA, 20 bp, mouse
gtgctctgagcagtgcatgt

SEQ ID NO: 851623 - DNA, 20 bp, mouse
ggtggccttgcgctataatt

SEQ ID NO: 851624 - DNA, 20 bp, mouse
ggtcgggctctgaaaaacat

SEQ ID NO: 851625 - DNA, 20 bp, mouse
gaccgatgtcgcggtaacca

SEQ ID NO: 851626 - DNA, 20 bp, mouse
gctggacccgctgaatccaa

SEQ ID NO: 851627 - DNA, 20 bp, mouse
ggcgccgctgctaaaccatc

SEQ ID NO: 851628 - DNA, 20 bp, mouse
gaggagtttagagtaacgga

SEQ ID NO: 851629 - DNA, 20 bp, mouse
gctgctaaaccatccggtcc

SEQ ID NO: 851630 - DNA, 20 bp, mouse
gctaaaccatccggtccggg

SEQ ID NO: 851631 - DNA, 20 bp, mouse
ggctctcgcccgcacctcag

SEQ ID NO: 851632 - DNA, 20 bp, mouse
gcgttactctaaactcctcc

SEQ ID NO: 851633 - DNA, 20 bp, mouse
gcatggggggcggtgacgcg

SEQ ID NO: 851634 - DNA, 20 bp, mouse
gcgagcagtgcgcccagctg

SEQ ID NO: 851635 - DNA, 20 bp, mouse
ggtgcgcccagctgaggatc

SEQ ID NO: 851636 - DNA, 20 bp, mouse
gacctccggagatggggcga

SEQ ID NO: 851637 - DNA, 20 bp, mouse
gggccccggctaggcaaacg

SEQ ID NO: 851638 - DNA, 20 bp, mouse
gtaacctgacctccggagat

SEQ ID NO: 851639 - DNA, 20 bp, mouse
ggggggggatgcctagagta

SEQ ID NO: 851640 - DNA, 20 bp, mouse
gagtacggctggatgggccc

SEQ ID NO: 851641 - DNA, 20 bp, mouse
gcccggctaggcaaacgggg

SEQ ID NO: 851642 - DNA, 20 bp, mouse
ggggatgcctagagtacggc

SEQ ID NO: 851643 - DNA, 20 bp, mouse
gggagctacgaagactacgc

SEQ ID NO: 851644 - DNA, 20 bp, mouse
gcgcttgcgtagtttgacgg

SEQ ID NO: 851645 - DNA, 20 bp, mouse
gcccctcgccccatctccgg

SEQ ID NO: 851646 - DNA, 20 bp, mouse
gtaggccgaaagtcgggcga

SEQ ID NO: 851647 - DNA, 20 bp, mouse
ggagtcggagacattgtcat

SEQ ID NO: 851648 - DNA, 20 bp, mouse
gtagcccgggaagtctgaac

SEQ ID NO: 851649 - DNA, 20 bp, mouse
ggggcccggttcagacttcc

SEQ ID NO: 851650 - DNA, 20 bp, mouse
gtgaaccgggcccatcagca

SEQ ID NO: 851651 - DNA, 20 bp, mouse
gcccgggctaggccgaaagt

SEQ ID NO: 851652 - DNA, 20 bp, mouse
gcacccgggaatcaaaaaat

SEQ ID NO: 851653 - DNA, 20 bp, mouse
gccgaaagtcgggcgagggg

SEQ ID NO: 851654 - DNA, 20 bp, mouse
gagcaggcgccgtgggggtg

SEQ ID NO: 851655 - DNA, 20 bp, mouse
gcagctacccggactcccgc

SEQ ID NO: 851656 - DNA, 20 bp, mouse
gtgggtgagcaagctggagt

SEQ ID NO: 851657 - DNA, 20 bp, mouse
gagaccagtctccaccccag

SEQ ID NO: 851658 - DNA, 20 bp, mouse
gcagatagagctctcccggt

SEQ ID NO: 851659 - DNA, 20 bp, mouse
ggtggagactggtctcccac

SEQ ID NO: 851660 - DNA, 20 bp, mouse
gtgtggttctcggaaagaaa

SEQ ID NO: 851661 - DNA, 20 bp, mouse
gtagccgggacccagattct

SEQ ID NO: 851662 - DNA, 20 bp, mouse
gtcgaaatcgaaattgaaat

SEQ ID NO: 851663 - DNA, 20 bp, mouse
gagagaggagtcttggcctc

SEQ ID NO: 851664 - DNA, 20 bp, mouse
gactctgtgaaagccctgtg

SEQ ID NO: 851665 - DNA, 20 bp, mouse
ggtgcagaggccatgatctt

SEQ ID NO: 851666 - DNA, 20 bp, mouse
gagtgggtgggcgggcgaga

SEQ ID NO: 851667 - DNA, 20 bp, mouse
gtctgcccaccagttcgcgg

SEQ ID NO: 851668 - DNA, 20 bp, mouse
gcgccagcggcggagtgggt

SEQ ID NO: 851669 - DNA, 20 bp, mouse
ggacgccgccgcgaactggt

SEQ ID NO: 851670 - DNA, 20 bp, mouse
gcaagccgactccggggaga

SEQ ID NO: 851671 - DNA, 20 bp, mouse
ggggtctgcccaccagttcg

SEQ ID NO: 851672 - DNA, 20 bp, mouse
gggcacccgcggtcgcctgt

SEQ ID NO: 851673 - DNA, 20 bp, mouse
ggggccggctcagtgcggtg

SEQ ID NO: 851674 - DNA, 20 bp, mouse
gtggcggctaggggcacccg

SEQ ID NO: 851675 - DNA, 20 bp, mouse
gtagccgccagcggcggagt

SEQ ID NO: 851676 - DNA, 20 bp, mouse
gcgcccgtgcgcacggtccc

SEQ ID NO: 851677 - DNA, 20 bp, mouse
gagcgggcggggcacgggct

SEQ ID NO: 851678 - DNA, 20 bp, mouse
ggagagggtgggggccggcc

SEQ ID NO: 851679 - DNA, 20 bp, mouse
ggagccggggaccgtgcgca

SEQ ID NO: 851680 - DNA, 20 bp, mouse
gggcgtacacaaggagccca

SEQ ID NO: 851681 - DNA, 20 bp, mouse
gggcgcccggggaccgggaa

SEQ ID NO: 851682 - DNA, 20 bp, mouse
gggtagcagtaaccgctgga

SEQ ID NO: 851683 - DNA, 20 bp, mouse
gcggccctgtcatctgccgg

SEQ ID NO: 851684 - DNA, 20 bp, mouse
gcctcccccggcagatgaca

SEQ ID NO: 851685 - DNA, 20 bp, mouse
gaacagctggcgggtgtcag

SEQ ID NO: 851686 - DNA, 20 bp, mouse
gagggggagcgtgaaatagg

SEQ ID NO: 851687 - DNA, 20 bp, mouse
gaggagggggagcgtgaaat

SEQ ID NO: 851688 - DNA, 20 bp, mouse
ggtggagcgtatttccgctc

SEQ ID NO: 851689 - DNA, 20 bp, mouse
gcgtcctcgcggactcgggg

SEQ ID NO: 851690 - DNA, 20 bp, mouse
gggcacccccacgcggttaa

SEQ ID NO: 851691 - DNA, 20 bp, mouse
gggggtgccgggggagaaaa

SEQ ID NO: 851692 - DNA, 20 bp, mouse
gcgcacgcgcagacgggccg

SEQ ID NO: 851693 - DNA, 20 bp, mouse
gccgcccagctgtgcgagtc

SEQ ID NO: 851694 - DNA, 20 bp, mouse
ggaactgtgcacacattcag

SEQ ID NO: 851695 - DNA, 20 bp, mouse
ggggaactgcgcaatctgcg

SEQ ID NO: 851696 - DNA, 20 bp, mouse
gagggacgggatggacgcgg

SEQ ID NO: 851697 - DNA, 20 bp, mouse
gcgggctccggggtagtggg

SEQ ID NO: 851698 - DNA, 20 bp, mouse
ggacgcgggggcacggtggg

SEQ ID NO: 851699 - DNA, 20 bp, mouse
ggggcggccccgtagaccca

SEQ ID NO: 851700 - DNA, 20 bp, mouse
gcttgcgcgctgccgagcga

SEQ ID NO: 851701 - DNA, 20 bp, mouse
gctcggcagcgcgcaagcca

SEQ ID NO: 851702 - DNA, 20 bp, mouse
gcgacagcgagcgtctgtag

SEQ ID NO: 851703 - DNA, 20 bp, mouse
gccaagctgcaggtaagcgc

SEQ ID NO: 851704 - DNA, 20 bp, mouse
gcgcgcgcgtgcgcaggcca

SEQ ID NO: 851705 - DNA, 20 bp, mouse
ggcttgcgcaggcacggaac

SEQ ID NO: 851706 - DNA, 20 bp, mouse
gaggacctggcagtccccaa

SEQ ID NO: 851707 - DNA, 20 bp, mouse
gggaggggagcgcccgggaa

SEQ ID NO: 851708 - DNA, 20 bp, mouse
gcggccgccagcactaaaga

SEQ ID NO: 851709 - DNA, 20 bp, mouse
ggggagcgcccgggaaggga

SEQ ID NO: 851710 - DNA, 20 bp, mouse
gcagggctgggagagcgcac

SEQ ID NO: 851711 - DNA, 20 bp, mouse
gggaagggaggggagcgccc

SEQ ID NO: 851712 - DNA, 20 bp, mouse
gcagtccccaaggggtcaga

SEQ ID NO: 851713 - DNA, 20 bp, mouse
gtgcgtgcctggggggttag

SEQ ID NO: 851714 - DNA, 20 bp, mouse
gccaggaccggccaggggga

SEQ ID NO: 851715 - DNA, 20 bp, mouse
ggggcgggccaggaccggcc

SEQ ID NO: 851716 - DNA, 20 bp, mouse
gctgtggagccggaaaacaa

SEQ ID NO: 851717 - DNA, 20 bp, mouse
gctggcgcagcgctcgtccg

SEQ ID NO: 851718 - DNA, 20 bp, mouse
gcggtgcacagcaagtgtcc

SEQ ID NO: 851719 - DNA, 20 bp, mouse
gaaacccagcaactcggact

SEQ ID NO: 851720 - DNA, 20 bp, mouse
gccagaagagcactaacttt

SEQ ID NO: 851721 - DNA, 20 bp, mouse
gacgagcgctgcgccagcga

SEQ ID NO: 851722 - DNA, 20 bp, mouse
gcataaagggagtcacaagt

SEQ ID NO: 851723 - DNA, 20 bp, mouse
gaaagagaggagaaagaact

SEQ ID NO: 851724 - DNA, 20 bp, mouse
gcccagccgggaagccagcg

SEQ ID NO: 851725 - DNA, 20 bp, mouse
gttgggaggagtgaaaactt

SEQ ID NO: 851726 - DNA, 20 bp, mouse
gtagccgtgatcaaattagg

SEQ ID NO: 851727 - DNA, 20 bp, mouse
gcagcctcctaatttgatca

SEQ ID NO: 851728 - DNA, 20 bp, mouse
gaggtagccgtgatcaaatt

SEQ ID NO: 851729 - DNA, 20 bp, mouse
ggattggagggcagctcaca

SEQ ID NO: 851730 - DNA, 20 bp, mouse
gactgtgtctcagcatagtg

SEQ ID NO: 851731 - DNA, 20 bp, mouse
gccagctgactgtggccata

SEQ ID NO: 851732 - DNA, 20 bp, mouse
ggctaaaaataaagattgga

SEQ ID NO: 851733 - DNA, 20 bp, mouse
gtcaatcctaatccttgaga

SEQ ID NO: 851734 - DNA, 20 bp, mouse
gtttagccctctcaaggatt

SEQ ID NO: 851735 - DNA, 20 bp, mouse
gacagctgtctggccaattc

SEQ ID NO: 851736 - DNA, 20 bp, mouse
gctaagaaaaagctggtggc

SEQ ID NO: 851737 - DNA, 20 bp, mouse
ggagtagcatatggcattaa

SEQ ID NO: 851738 - DNA, 20 bp, mouse
gtaaaaggctgagggatggc

SEQ ID NO: 851739 - DNA, 20 bp, mouse
ggggactagagatgtcaaat

SEQ ID NO: 851740 - DNA, 20 bp, mouse
gagtgtgtgcggatctgtgg

SEQ ID NO: 851741 - DNA, 20 bp, mouse
ggacagggagttagtgtgtg

SEQ ID NO: 851742 - DNA, 20 bp, mouse
gtctcctaagaaaaagctgg

SEQ ID NO: 851743 - DNA, 20 bp, mouse
gcacttctgcctcaagttgg

SEQ ID NO: 851744 - DNA, 20 bp, mouse
gagtgtagaggagtagcata

SEQ ID NO: 851745 - DNA, 20 bp, mouse
gctgcctcaagttggtggac

SEQ ID NO: 851746 - DNA, 20 bp, mouse
gcggagcgactagtgcaaag

SEQ ID NO: 851747 - DNA, 20 bp, mouse
gagggcgggcgcaaggggag

SEQ ID NO: 851748 - DNA, 20 bp, mouse
ggccgcggcggggcgtgaga

SEQ ID NO: 851749 - DNA, 20 bp, mouse
ggcgccggagacaccgaccg

SEQ ID NO: 851750 - DNA, 20 bp, mouse
gtcccgccgggggggagagg

SEQ ID NO: 851751 - DNA, 20 bp, mouse
gccggagacaccgaccgcgg

SEQ ID NO: 851752 - DNA, 20 bp, mouse
gtctcagcggccgggcccgg

SEQ ID NO: 851753 - DNA, 20 bp, mouse
ggcttgcagaactttggctg

SEQ ID NO: 851754 - DNA, 20 bp, mouse
gggcggcggcggggacagtt

SEQ ID NO: 851755 - DNA, 20 bp, mouse
gcggcggggcttttcctgtc

SEQ ID NO: 851756 - DNA, 20 bp, mouse
gactgcccaccatagctcac

SEQ ID NO: 851757 - DNA, 20 bp, mouse
gagctatggtgggcagtcag

SEQ ID NO: 851758 - DNA, 20 bp, mouse
gtcagaggccgtgaaaggaa

SEQ ID NO: 851759 - DNA, 20 bp, mouse
gggcagtcagaggccgtgaa

SEQ ID NO: 851760 - DNA, 20 bp, mouse
gtcaggactctgtatataat

SEQ ID NO: 851761 - DNA, 20 bp, mouse
gtacttagtgagtattatct

SEQ ID NO: 851762 - DNA, 20 bp, mouse
gactagaaagagcagcatcc

SEQ ID NO: 851763 - DNA, 20 bp, mouse
gttttggcatcaatgcactg

SEQ ID NO: 851764 - DNA, 20 bp, mouse
gctaacatccaactttcaaa

SEQ ID NO: 851765 - DNA, 20 bp, mouse
gtgaatctccagcatcatcc

SEQ ID NO: 851766 - DNA, 20 bp, mouse
gcgggcccgacgtcctccta

SEQ ID NO: 851767 - DNA, 20 bp, mouse
gtgcccgcgcctcaccggag

SEQ ID NO: 851768 - DNA, 20 bp, mouse
ggcacgagcagcagagcgta

SEQ ID NO: 851769 - DNA, 20 bp, mouse
gcgttggtgcctctccggtg

SEQ ID NO: 851770 - DNA, 20 bp, mouse
gagcgcggccgcgttgggtc

SEQ ID NO: 851771 - DNA, 20 bp, mouse
gcgcccccagggtacgcatg

SEQ ID NO: 851772 - DNA, 20 bp, mouse
gcaacgcgccggacccaacg

SEQ ID NO: 851773 - DNA, 20 bp, mouse
gcggagaggcaccaacgcgc

SEQ ID NO: 851774 - DNA, 20 bp, mouse
ggctcgtgcccgcgcctcac

SEQ ID NO: 851775 - DNA, 20 bp, mouse
gaggacgtcgggcccggtcg

SEQ ID NO: 851776 - DNA, 20 bp, mouse
gctggtcaatgagacaaggt

SEQ ID NO: 851777 - DNA, 20 bp, mouse
gtaggcttgtcggattaaag

SEQ ID NO: 851778 - DNA, 20 bp, mouse
gacgggacctggtaccttta

SEQ ID NO: 851779 - DNA, 20 bp, mouse
gtaaaggggaacgaaggttt

SEQ ID NO: 851780 - DNA, 20 bp, mouse
gaggtaccaggtcccgtctg

SEQ ID NO: 851781 - DNA, 20 bp, mouse
ggaggactcaggaattggtt

SEQ ID NO: 851782 - DNA, 20 bp, mouse
gagcactggtcaatgagaca

SEQ ID NO: 851783 - DNA, 20 bp, mouse
gtcggattaaaggggaacga

SEQ ID NO: 851784 - DNA, 20 bp, mouse
gaggtcgcaggtccgggagg

SEQ ID NO: 851785 - DNA, 20 bp, mouse
gtaacgtccagagctcgggg

SEQ ID NO: 851786 - DNA, 20 bp, mouse
gaactcagcggggtaactgg

SEQ ID NO: 851787 - DNA, 20 bp, mouse
gaatccggaaagggagggtc

SEQ ID NO: 851788 - DNA, 20 bp, mouse
gggaaactcagcggggtaac

SEQ ID NO: 851789 - DNA, 20 bp, mouse
gttgctgtggaatccggaaa

SEQ ID NO: 851790 - DNA, 20 bp, mouse
gcgaggaagaggattcattc

SEQ ID NO: 851791 - DNA, 20 bp, mouse
ggagctgaggatgagtaact

SEQ ID NO: 851792 - DNA, 20 bp, mouse
ggcaaagcccgccctcgggg

SEQ ID NO: 851793 - DNA, 20 bp, mouse
gggacttaggagcattggtc

SEQ ID NO: 851794 - DNA, 20 bp, mouse
gtaacttgggaaggaaagcg

SEQ ID NO: 851795 - DNA, 20 bp, mouse
ggcggatgtggtgtctactg

SEQ ID NO: 851796 - DNA, 20 bp, mouse
gcccggcagtccggtcacgt

SEQ ID NO: 851797 - DNA, 20 bp, mouse
gccggcgggctgctctcgcg

SEQ ID NO: 851798 - DNA, 20 bp, mouse
gccgcctccagtcacgactg

SEQ ID NO: 851799 - DNA, 20 bp, mouse
gcgcccgctcacgcacccgg

SEQ ID NO: 851800 - DNA, 20 bp, mouse
gcaggcacgcacactagccg

SEQ ID NO: 851801 - DNA, 20 bp, mouse
gagcccgccgggtgcgtgag

SEQ ID NO: 851802 - DNA, 20 bp, mouse
gtccgggcgcgcctctgcca

SEQ ID NO: 851803 - DNA, 20 bp, mouse
ggactggaggcggaagtgtg

SEQ ID NO: 851804 - DNA, 20 bp, mouse
gcccgcccgagtggccaagg

SEQ ID NO: 851805 - DNA, 20 bp, mouse
gcggactgccgggaagcgag

SEQ ID NO: 851806 - DNA, 20 bp, mouse
gggaatgctcggaggacgac

SEQ ID NO: 851807 - DNA, 20 bp, mouse
gaacgcggaaagtccctctc

SEQ ID NO: 851808 - DNA, 20 bp, mouse
ggaatcgggctgcggagggt

SEQ ID NO: 851809 - DNA, 20 bp, mouse
gggggcgaggccagggaatc

SEQ ID NO: 851810 - DNA, 20 bp, mouse
ggtcctccgagcattccgat

SEQ ID NO: 851811 - DNA, 20 bp, mouse
gggacccaacggaaccggaa

SEQ ID NO: 851812 - DNA, 20 bp, mouse
gcctccgcagcccgattccc

SEQ ID NO: 851813 - DNA, 20 bp, mouse
gggacgacgggcccctgaga

SEQ ID NO: 851814 - DNA, 20 bp, mouse
gcgccaatcggaatgctcgg

SEQ ID NO: 851815 - DNA, 20 bp, mouse
ggattggcggagatgaccat

SEQ ID NO: 851816 - DNA, 20 bp, mouse
gtggagaagccggttatcga

SEQ ID NO: 851817 - DNA, 20 bp, mouse
gagcctcgacgcctgagcaa

SEQ ID NO: 851818 - DNA, 20 bp, mouse
gtaccccgcccctcgataac

SEQ ID NO: 851819 - DNA, 20 bp, mouse
gccctcagagacctcaggat

SEQ ID NO: 851820 - DNA, 20 bp, mouse
gaggaagaaaagtttaggac

SEQ ID NO: 851821 - DNA, 20 bp, mouse
gcaggcgggtaatttcccta

SEQ ID NO: 851822 - DNA, 20 bp, mouse
gggatgaggaagaaaagttt

SEQ ID NO: 851823 - DNA, 20 bp, mouse
gtctgagggaaggcgggatg

SEQ ID NO: 851824 - DNA, 20 bp, mouse
gtgccattgctcaggcgtcg

SEQ ID NO: 851825 - DNA, 20 bp, mouse
ggccctctcttgttgtggat

SEQ ID NO: 851826 - DNA, 20 bp, mouse
gtggctggtcagcacccaac

SEQ ID NO: 851827 - DNA, 20 bp, mouse
ggtgacagaaaggtcagagt

SEQ ID NO: 851828 - DNA, 20 bp, mouse
gttgcggcttacacacctcc

SEQ ID NO: 851829 - DNA, 20 bp, mouse
gtgtaactaatcaacactgt

SEQ ID NO: 851830 - DNA, 20 bp, mouse
gctcgggccttgagtctgat

SEQ ID NO: 851831 - DNA, 20 bp, mouse
gactgaggctgtgcacgcgc

SEQ ID NO: 851832 - DNA, 20 bp, mouse
ggccttgagtctgattggcc

SEQ ID NO: 851833 - DNA, 20 bp, mouse
gtttcttattggtgcctgtt

SEQ ID NO: 851834 - DNA, 20 bp, mouse
gtggaggtgctcaaatagcc

SEQ ID NO: 851835 - DNA, 20 bp, mouse
gttgagtctgattggcctgg

SEQ ID NO: 851836 - DNA, 20 bp, mouse
gagagcgcgaagcccgcctt

SEQ ID NO: 851837 - DNA, 20 bp, mouse
gagagcagcccggggttgtc

SEQ ID NO: 851838 - DNA, 20 bp, mouse
gccgacagagggcgcagcgt

SEQ ID NO: 851839 - DNA, 20 bp, mouse
gacagagggcgcagcgtggg

SEQ ID NO: 851840 - DNA, 20 bp, mouse
gcgctcttccggacaacccc

SEQ ID NO: 851841 - DNA, 20 bp, mouse
gccactcctaacagtgtcat

SEQ ID NO: 851842 - DNA, 20 bp, mouse
ggaagccgctttgacgtcgg

SEQ ID NO: 851843 - DNA, 20 bp, mouse
gcccgggctgctctcggaag

SEQ ID NO: 851844 - DNA, 20 bp, mouse
gcagtcacggaaagagccga

SEQ ID NO: 851845 - DNA, 20 bp, mouse
ggccgggctccgccgacaga

SEQ ID NO: 851846 - DNA, 20 bp, mouse
gtacccgcccgtctactggt

SEQ ID NO: 851847 - DNA, 20 bp, mouse
gaggccgaccagtagacggg

SEQ ID NO: 851848 - DNA, 20 bp, mouse
gacccgggcgggtgtcgata

SEQ ID NO: 851849 - DNA, 20 bp, mouse
gcacccggaccctaagcctg

SEQ ID NO: 851850 - DNA, 20 bp, mouse
gggcgcccgcgcttccgggc

SEQ ID NO: 851851 - DNA, 20 bp, mouse
gcaggagctgggattccgac

SEQ ID NO: 851852 - DNA, 20 bp, mouse
gctgcaggccgaccagtaga

SEQ ID NO: 851853 - DNA, 20 bp, mouse
gtggccggacttctcgcggc

SEQ ID NO: 851854 - DNA, 20 bp, mouse
gaaaagctgcccaggtagtt

SEQ ID NO: 851855 - DNA, 20 bp, mouse
gcggcccgccgcgagaagtc

SEQ ID NO: 851856 - DNA, 20 bp, mouse
gccgccctccgggctctcgg

SEQ ID NO: 851857 - DNA, 20 bp, mouse
gacgcccccgagagcccgga

SEQ ID NO: 851858 - DNA, 20 bp, mouse
gccgcctccctgaggagtac

SEQ ID NO: 851859 - DNA, 20 bp, mouse
gccggagggcggagttgccg

SEQ ID NO: 851860 - DNA, 20 bp, mouse
ggccagagggaaagttttgt

SEQ ID NO: 851861 - DNA, 20 bp, mouse
gccctcagcctgtactcctc

SEQ ID NO: 851862 - DNA, 20 bp, mouse
ggagttgccgcgggcacgat

SEQ ID NO: 851863 - DNA, 20 bp, mouse
gggcgggcctatcgtgcccg

SEQ ID NO: 851864 - DNA, 20 bp, mouse
gcctgcaaggaaagcgctgg

SEQ ID NO: 851865 - DNA, 20 bp, mouse
gtctgagggcgtgtgagggg

SEQ ID NO: 851866 - DNA, 20 bp, mouse
gctgccctgccactcggaaa

SEQ ID NO: 851867 - DNA, 20 bp, mouse
ggagggcctctggacatcaa

SEQ ID NO: 851868 - DNA, 20 bp, mouse
ggccagcctgcaagagagga

SEQ ID NO: 851869 - DNA, 20 bp, mouse
gactgttccggaaggaggaa

SEQ ID NO: 851870 - DNA, 20 bp, mouse
gtcaacaaggcctccctgaa

SEQ ID NO: 851871 - DNA, 20 bp, mouse
ggaggccagtggcaagccgt

SEQ ID NO: 851872 - DNA, 20 bp, mouse
gaggccttgttgaatctgtc

SEQ ID NO: 851873 - DNA, 20 bp, mouse
gcgcagccagcctgcaagag

SEQ ID NO: 851874 - DNA, 20 bp, mouse
gaagaaggaagatacgtgat

SEQ ID NO: 851875 - DNA, 20 bp, mouse
gacagagagtggtctcaccc

SEQ ID NO: 851876 - DNA, 20 bp, mouse
gcgactccggggcgtggagg

SEQ ID NO: 851877 - DNA, 20 bp, mouse
gatctcatcgcgaacgggta

SEQ ID NO: 851878 - DNA, 20 bp, mouse
ggactgtcgcgcctcccctc

SEQ ID NO: 851879 - DNA, 20 bp, mouse
gcgggtttgcgcttcaccgg

SEQ ID NO: 851880 - DNA, 20 bp, mouse
gccaccaggctcggctgcag

SEQ ID NO: 851881 - DNA, 20 bp, mouse
gcggaccccgcgcacttacg

SEQ ID NO: 851882 - DNA, 20 bp, mouse
gcgtcccgccccaccaggct

SEQ ID NO: 851883 - DNA, 20 bp, mouse
ggtgacgcgcacctggggct

SEQ ID NO: 851884 - DNA, 20 bp, mouse
gcggacgctggctgctccgt

SEQ ID NO: 851885 - DNA, 20 bp, mouse
gggggagtgacgcgcacctg

SEQ ID NO: 851886 - DNA, 20 bp, mouse
gaggaggcagcgccccccga

SEQ ID NO: 851887 - DNA, 20 bp, mouse
ggctccgcccggccgtcggg

SEQ ID NO: 851888 - DNA, 20 bp, mouse
gcccaggcgccacagcgagc

SEQ ID NO: 851889 - DNA, 20 bp, mouse
gcgtggctccgcccggccgt

SEQ ID NO: 851890 - DNA, 20 bp, mouse
gactcccgcgagctttctga

SEQ ID NO: 851891 - DNA, 20 bp, mouse
gcacagcgagcgggctggtg

SEQ ID NO: 851892 - DNA, 20 bp, mouse
gcgcctggggagtgaaaagc

SEQ ID NO: 851893 - DNA, 20 bp, mouse
ggctcggcggatggagagtc

SEQ ID NO: 851894 - DNA, 20 bp, mouse
gggcggcgccgcctcctcgt

SEQ ID NO: 851895 - DNA, 20 bp, mouse
gggcgcggcgagcggctcgg

SEQ ID NO: 851896 - DNA, 20 bp, mouse
ggcctggtggatccctcaca

SEQ ID NO: 851897 - DNA, 20 bp, mouse
gggggagccgatgatgtcag

SEQ ID NO: 851898 - DNA, 20 bp, mouse
gccccagcgccgccgctgag

SEQ ID NO: 851899 - DNA, 20 bp, mouse
gcccagggaatgagtggtct

SEQ ID NO: 851900 - DNA, 20 bp, mouse
gggtcactgcccgccccgta

SEQ ID NO: 851901 - DNA, 20 bp, mouse
gctctgaagtctgatggcca

SEQ ID NO: 851902 - DNA, 20 bp, mouse
ggatgtgacccctgagtgaa

SEQ ID NO: 851903 - DNA, 20 bp, mouse
gaatgcacaccttacggggc

SEQ ID NO: 851904 - DNA, 20 bp, mouse
gtggggggggactgtttccg

SEQ ID NO: 851905 - DNA, 20 bp, mouse
gtgggggtgagtcccttccc

SEQ ID NO: 851906 - DNA, 20 bp, mouse
ggctaaggaaacatctccca

SEQ ID NO: 851907 - DNA, 20 bp, mouse
gctcagaagtggctaggtaa

SEQ ID NO: 851908 - DNA, 20 bp, mouse
gtaagggatggatcatgcta

SEQ ID NO: 851909 - DNA, 20 bp, mouse
ggaagtggctaggtaaggga

SEQ ID NO: 851910 - DNA, 20 bp, mouse
gccaaggtactgtgaggcga

SEQ ID NO: 851911 - DNA, 20 bp, mouse
gtcgcagcaaacctcagaag

SEQ ID NO: 851912 - DNA, 20 bp, mouse
gtctggactgggcttggtat

SEQ ID NO: 851913 - DNA, 20 bp, mouse
gcagtcaaatggatgtgaat

SEQ ID NO: 851914 - DNA, 20 bp, mouse
ggcagaccaggttccaaact

SEQ ID NO: 851915 - DNA, 20 bp, mouse
gcgccgtagtcacgtgctgg

SEQ ID NO: 851916 - DNA, 20 bp, mouse
gcggacctgggacctcggta

SEQ ID NO: 851917 - DNA, 20 bp, mouse
gaaaaacttggctgcgggag

SEQ ID NO: 851918 - DNA, 20 bp, mouse
ggacctcggtagggcaccca

SEQ ID NO: 851919 - DNA, 20 bp, mouse
gggtgccctaccgaggtccc

SEQ ID NO: 851920 - DNA, 20 bp, mouse
gcagccgccgcgagaagccg

SEQ ID NO: 851921 - DNA, 20 bp, mouse
gggaagatagctgtgatgag

SEQ ID NO: 851922 - DNA, 20 bp, mouse
ggttaacgagggcccttaag

SEQ ID NO: 851923 - DNA, 20 bp, mouse
gtagctgtgatgaggggtta

SEQ ID NO: 851924 - DNA, 20 bp, mouse
gaaagcgggtataacggacc

SEQ ID NO: 851925 - DNA, 20 bp, mouse
gtgcgctcgggcggatgccg

SEQ ID NO: 851926 - DNA, 20 bp, mouse
gcgggtggggcggacagaga

SEQ ID NO: 851927 - DNA, 20 bp, mouse
gagcccgccgcactctgtga

SEQ ID NO: 851928 - DNA, 20 bp, mouse
gcccctcccgtcacagagtg

SEQ ID NO: 851929 - DNA, 20 bp, mouse
gtagcgggactgaccgggtg

SEQ ID NO: 851930 - DNA, 20 bp, mouse
gcggagcggccgaaccgctg

SEQ ID NO: 851931 - DNA, 20 bp, mouse
gcggcgggctagcttctagc

SEQ ID NO: 851932 - DNA, 20 bp, mouse
gggacagagaaggggtagcg

SEQ ID NO: 851933 - DNA, 20 bp, mouse
gcagggcagtcgggacccca

SEQ ID NO: 851934 - DNA, 20 bp, mouse
ggccgcactctgtgacggga

SEQ ID NO: 851935 - DNA, 20 bp, mouse
gagcttctagcgggactgac

SEQ ID NO: 851936 - DNA, 20 bp, mouse
gggtactggcgtctgcgcaa

SEQ ID NO: 851937 - DNA, 20 bp, mouse
gtgctccaggcgtgctttcg

SEQ ID NO: 851938 - DNA, 20 bp, mouse
ggagagcacgcgcagggtac

SEQ ID NO: 851939 - DNA, 20 bp, mouse
ggaagcactggcaatttcga

SEQ ID NO: 851940 - DNA, 20 bp, mouse
gcttcaggagagcacgcgca

SEQ ID NO: 851941 - DNA, 20 bp, mouse
ggatcagaaagcgtatccga

SEQ ID NO: 851942 - DNA, 20 bp, mouse
ggaggcgtgtcgtcgacgct

SEQ ID NO: 851943 - DNA, 20 bp, mouse
ggctttcggggcgggtcttc

SEQ ID NO: 851944 - DNA, 20 bp, mouse
ggtagctctggaagccttag

SEQ ID NO: 851945 - DNA, 20 bp, mouse
gaaattgccagtgcttccgg

SEQ ID NO: 851946 - DNA, 20 bp, mouse
gcccgctgtgcttcagcgtc

SEQ ID NO: 851947 - DNA, 20 bp, mouse
gcggccggccggcccggcct

SEQ ID NO: 851948 - DNA, 20 bp, mouse
gtacgggacgacaacccgac

SEQ ID NO: 851949 - DNA, 20 bp, mouse
gtggtctggtcctgcgccga

SEQ ID NO: 851950 - DNA, 20 bp, mouse
gtggcttgcaccaccggcga

SEQ ID NO: 851951 - DNA, 20 bp, mouse
gcgcccgtgggcctgagggg

SEQ ID NO: 851952 - DNA, 20 bp, mouse
gaggaccagaccacagctac

SEQ ID NO: 851953 - DNA, 20 bp, mouse
gggagtgaaacgagcggcta

SEQ ID NO: 851954 - DNA, 20 bp, mouse
gagcgtctggcttgcaccac

SEQ ID NO: 851955 - DNA, 20 bp, mouse
gcaggctggagtgaaacgag

SEQ ID NO: 851956 - DNA, 20 bp, mouse
ggacccgctgagagtactga

SEQ ID NO: 851957 - DNA, 20 bp, mouse
gcggatcagcctggagacga

SEQ ID NO: 851958 - DNA, 20 bp, mouse
gctggggatcagtaggcaga

SEQ ID NO: 851959 - DNA, 20 bp, mouse
gaagctggggaccgaagagc

SEQ ID NO: 851960 - DNA, 20 bp, mouse
ggagctgtcaatcactcctc

SEQ ID NO: 851961 - DNA, 20 bp, mouse
gaaccaaaatcgcagaagct

SEQ ID NO: 851962 - DNA, 20 bp, mouse
gagtcgttgagcagaacttc

SEQ ID NO: 851963 - DNA, 20 bp, mouse
ggcaggagtccgtcgtctcc

SEQ ID NO: 851964 - DNA, 20 bp, mouse
gctctcagcgggtctggaga

SEQ ID NO: 851965 - DNA, 20 bp, mouse
gcacaggcggaacgatagtc

SEQ ID NO: 851966 - DNA, 20 bp, mouse
gctcccgcggggctggacag

SEQ ID NO: 851967 - DNA, 20 bp, mouse
gcgcccagccggcggagcgg

SEQ ID NO: 851968 - DNA, 20 bp, mouse
gtgggccgccggtgctccgg

SEQ ID NO: 851969 - DNA, 20 bp, mouse
ggtgggaaaccccctcccat

SEQ ID NO: 851970 - DNA, 20 bp, mouse
gtctcccatcaggtggtctc

SEQ ID NO: 851971 - DNA, 20 bp, mouse
ggggcgcgagcgtcgaccca

SEQ ID NO: 851972 - DNA, 20 bp, mouse
ggcgcccggccgccgctgat

SEQ ID NO: 851973 - DNA, 20 bp, mouse
gagtgcggaccaatcagcgg

SEQ ID NO: 851974 - DNA, 20 bp, mouse
gggagctcgctgggcattgt

SEQ ID NO: 851975 - DNA, 20 bp, mouse
gccgcactgcgccctggcct

SEQ ID NO: 851976 - DNA, 20 bp, mouse
gtcctcgggtcccgcctcaa

SEQ ID NO: 851977 - DNA, 20 bp, mouse
gcgctggggctgttgagaat

SEQ ID NO: 851978 - DNA, 20 bp, mouse
gagaccaatgggcagcatag

SEQ ID NO: 851979 - DNA, 20 bp, mouse
gggaccgcacaccaactagc

SEQ ID NO: 851980 - DNA, 20 bp, mouse
gagcctcagaaagagaccaa

SEQ ID NO: 851981 - DNA, 20 bp, mouse
gtcgcctagtaacgccaagc

SEQ ID NO: 851982 - DNA, 20 bp, mouse
ggacgtgaaacgtgtgtgtg

SEQ ID NO: 851983 - DNA, 20 bp, mouse
gactcgggacccagcgcggt

SEQ ID NO: 851984 - DNA, 20 bp, mouse
ggaaggtggcgggtcgagtg

SEQ ID NO: 851985 - DNA, 20 bp, mouse
gtggctgctattccggtctg

SEQ ID NO: 851986 - DNA, 20 bp, mouse
gcccgcgcagaactcaatcc

SEQ ID NO: 851987 - DNA, 20 bp, mouse
gccaacgcgcgtgcgcgcag

SEQ ID NO: 851988 - DNA, 20 bp, mouse
gttgagaccgttggcggggt

SEQ ID NO: 851989 - DNA, 20 bp, mouse
ggcccttcctccatgtcccg

SEQ ID NO: 851990 - DNA, 20 bp, mouse
gcatggaggaagggcgatgg

SEQ ID NO: 851991 - DNA, 20 bp, mouse
gtggctgggcgagccggtgg

SEQ ID NO: 851992 - DNA, 20 bp, mouse
ggccgggattgagttctgcg

SEQ ID NO: 851993 - DNA, 20 bp, mouse
ggccggtggcggtgctacgc

SEQ ID NO: 851994 - DNA, 20 bp, mouse
ggtggcggtgctacgctggg

SEQ ID NO: 851995 - DNA, 20 bp, mouse
gggacatggaggaagggcga

SEQ ID NO: 851996 - DNA, 20 bp, mouse
gtaaacacagccggggtcct

SEQ ID NO: 851997 - DNA, 20 bp, mouse
gcattggaggcctgtggagg

SEQ ID NO: 851998 - DNA, 20 bp, mouse
gcctccaatggccaatcatc

SEQ ID NO: 851999 - DNA, 20 bp, mouse
gcctacagtaaacggatgtg

SEQ ID NO: 852000 - DNA, 20 bp, mouse
gcctgtggaggcggtgacat

SEQ ID NO: 852001 - DNA, 20 bp, mouse
gcctcctgatgattggccat

SEQ ID NO: 852002 - DNA, 20 bp, mouse
ggccaatcatcaggagggcg

SEQ ID NO: 852003 - DNA, 20 bp, mouse
gggcggaggcctacagtaaa

SEQ ID NO: 852004 - DNA, 20 bp, mouse
gcgagccaatggagggactc

SEQ ID NO: 852005 - DNA, 20 bp, mouse
gctgaaggagccgggagcga

SEQ ID NO: 852006 - DNA, 20 bp, mouse
gaggaacggccagaaagacc

SEQ ID NO: 852007 - DNA, 20 bp, mouse
ggaggggagggcaaagagac

SEQ ID NO: 852008 - DNA, 20 bp, mouse
ggctccgcccctcaactcct

SEQ ID NO: 852009 - DNA, 20 bp, mouse
gagttgaggggcggagccga

SEQ ID NO: 852010 - DNA, 20 bp, mouse
gtcctgcagcggaaaaagag

SEQ ID NO: 852011 - DNA, 20 bp, mouse
ggggagggcaaagagactgg

SEQ ID NO: 852012 - DNA, 20 bp, mouse
gaggacctggccctaacctc

SEQ ID NO: 852013 - DNA, 20 bp, mouse
ggcagcaaacagcttcatac

SEQ ID NO: 852014 - DNA, 20 bp, mouse
gagcgaagaacgctcagggc

SEQ ID NO: 852015 - DNA, 20 bp, mouse
gtcagcgagccgggtctttc

SEQ ID NO: 852016 - DNA, 20 bp, mouse
gggaatgctcggaggacgac

SEQ ID NO: 852017 - DNA, 20 bp, mouse
ggaatcgggctgcggagggt

SEQ ID NO: 852018 - DNA, 20 bp, mouse
gaacgcggaaagtccctctc

SEQ ID NO: 852019 - DNA, 20 bp, mouse
gggggcgaggccagggaatc

SEQ ID NO: 852020 - DNA, 20 bp, mouse
ggtcctccgagcattccgat

SEQ ID NO: 852021 - DNA, 20 bp, mouse
gcctccgcagcccgattccc

SEQ ID NO: 852022 - DNA, 20 bp, mouse
gggacccaacggaaccggaa

SEQ ID NO: 852023 - DNA, 20 bp, mouse
gggacgacgggcccctgaga

SEQ ID NO: 852024 - DNA, 20 bp, mouse
ggcagcgagtccacatccct

SEQ ID NO: 852025 - DNA, 20 bp, mouse
gcgccaatcggaatgctcgg

SEQ ID NO: 852026 - DNA, 20 bp, mouse
gcacggggcggagaggtcac

SEQ ID NO: 852027 - DNA, 20 bp, mouse
gtgcgccgcgagagcagatc

SEQ ID NO: 852028 - DNA, 20 bp, mouse
ggggaggggccgatgggtcg

SEQ ID NO: 852029 - DNA, 20 bp, mouse
ggggggggcgggctgggcgt

SEQ ID NO: 852030 - DNA, 20 bp, mouse
ggcagcccgatctgctctcg

SEQ ID NO: 852031 - DNA, 20 bp, mouse
gcagaacaggctctgcaggt

SEQ ID NO: 852032 - DNA, 20 bp, mouse
ggggctgcgattagggattt

SEQ ID NO: 852033 - DNA, 20 bp, mouse
ggggtcctccctcgtcttaa

SEQ ID NO: 852034 - DNA, 20 bp, mouse
ggggccgtagataagccagc

SEQ ID NO: 852035 - DNA, 20 bp, mouse
gcccgcccccccggccaccg

SEQ ID NO: 852036 - DNA, 20 bp, mouse
gccaggggagggtgtggtgt

SEQ ID NO: 852037 - DNA, 20 bp, mouse
gggcctcggggcttcaggcg

SEQ ID NO: 852038 - DNA, 20 bp, mouse
gggggagggtgtggtgtcgg

SEQ ID NO: 852039 - DNA, 20 bp, mouse
gcctccccccagcccgggtg

SEQ ID NO: 852040 - DNA, 20 bp, mouse
ggacgggcggacccagatcc

SEQ ID NO: 852041 - DNA, 20 bp, mouse
ggggatgcgcggcctggcgc

SEQ ID NO: 852042 - DNA, 20 bp, mouse
gtagttccggacgctcaggg

SEQ ID NO: 852043 - DNA, 20 bp, mouse
ggcgcgggggaggtgacggg

SEQ ID NO: 852044 - DNA, 20 bp, mouse
gactggaggttccctcccca

SEQ ID NO: 852045 - DNA, 20 bp, mouse
gtcggggcttcaggcgaggc

SEQ ID NO: 852046 - DNA, 20 bp, mouse
gtggaagccaggtgaatgta

SEQ ID NO: 852047 - DNA, 20 bp, mouse
gaggaggcaaagggtggcgg

SEQ ID NO: 852048 - DNA, 20 bp, mouse
gagggctggacgggggtcgg

SEQ ID NO: 852049 - DNA, 20 bp, mouse
gacagtgtccgcagtggcca

SEQ ID NO: 852050 - DNA, 20 bp, mouse
gtgacagagggtgttgctaa

SEQ ID NO: 852051 - DNA, 20 bp, mouse
gtgacggcgccccgcgggga

SEQ ID NO: 852052 - DNA, 20 bp, mouse
gccactgcggacactgtctt

SEQ ID NO: 852053 - DNA, 20 bp, mouse
gccaacagctagttccagca

SEQ ID NO: 852054 - DNA, 20 bp, mouse
gtccttattgggcggaggga

SEQ ID NO: 852055 - DNA, 20 bp, mouse
gtcaccacctggggagggaa

SEQ ID NO: 852056 - DNA, 20 bp, mouse
ggaaacgaaagcaagggcgg

SEQ ID NO: 852057 - DNA, 20 bp, mouse
ggtcccgcgttcaacagtac

SEQ ID NO: 852058 - DNA, 20 bp, mouse
gcagtacaggtggacgaaag

SEQ ID NO: 852059 - DNA, 20 bp, mouse
gcacctgtactgttgaacgc

SEQ ID NO: 852060 - DNA, 20 bp, mouse
gacaggtggacgaaaggggc

SEQ ID NO: 852061 - DNA, 20 bp, mouse
gccctccaaccagaagtatt

SEQ ID NO: 852062 - DNA, 20 bp, mouse
gtaaaacggaaacgaaagca

SEQ ID NO: 852063 - DNA, 20 bp, mouse
gacggaaacgaaagcaaggg

SEQ ID NO: 852064 - DNA, 20 bp, mouse
gcaaggaccaattgctccag

SEQ ID NO: 852065 - DNA, 20 bp, mouse
ggctggctgccaaatacttc

SEQ ID NO: 852066 - DNA, 20 bp, mouse
ggtgtgcggtcgcctctctc

SEQ ID NO: 852067 - DNA, 20 bp, mouse
gtaaagggcccggatgtgtg

SEQ ID NO: 852068 - DNA, 20 bp, mouse
ggccgcagcaagtgcatgtg

SEQ ID NO: 852069 - DNA, 20 bp, mouse
gcgggcggcaagcaggagtc

SEQ ID NO: 852070 - DNA, 20 bp, mouse
gacgcccaggacccccgcgc

SEQ ID NO: 852071 - DNA, 20 bp, mouse
gagaggcgaccgcacacatc

SEQ ID NO: 852072 - DNA, 20 bp, mouse
gcagagccacccagcgctgg

SEQ ID NO: 852073 - DNA, 20 bp, mouse
gtggcccgtcgcctcggccg

SEQ ID NO: 852074 - DNA, 20 bp, mouse
gcgggggtcctgggcgtcct

SEQ ID NO: 852075 - DNA, 20 bp, mouse
gggcgcggggctgccagccg

SEQ ID NO: 852076 - DNA, 20 bp, mouse
gtgaagaggcaagcccggag

SEQ ID NO: 852077 - DNA, 20 bp, mouse
gcgggcgtgggcacggacag

SEQ ID NO: 852078 - DNA, 20 bp, mouse
ggatccccaatcaactgctg

SEQ ID NO: 852079 - DNA, 20 bp, mouse
gtgggaaaggcgcctccgga

SEQ ID NO: 852080 - DNA, 20 bp, mouse
gtgcctgcggagggtgcagt

SEQ ID NO: 852081 - DNA, 20 bp, mouse
gcagcccttctgccctccgg

SEQ ID NO: 852082 - DNA, 20 bp, mouse
ggcgccctagtgcctgcgga

SEQ ID NO: 852083 - DNA, 20 bp, mouse
gagtgggcgaagctgctggt

SEQ ID NO: 852084 - DNA, 20 bp, mouse
ggttccccagcagttgattg

SEQ ID NO: 852085 - DNA, 20 bp, mouse
gcggagggtgcagtcgggcg

SEQ ID NO: 852086 - DNA, 20 bp, mouse
gaccaatggtgggagatctt

SEQ ID NO: 852087 - DNA, 20 bp, mouse
gcagccagcaggtccgtcaa

SEQ ID NO: 852088 - DNA, 20 bp, mouse
gtgaagactccagcgttcat

SEQ ID NO: 852089 - DNA, 20 bp, mouse
gaagcggggaagatgaccaa

SEQ ID NO: 852090 - DNA, 20 bp, mouse
gtccgggtacccacctctgg

SEQ ID NO: 852091 - DNA, 20 bp, mouse
gtggtccgggtacccacctc

SEQ ID NO: 852092 - DNA, 20 bp, mouse
ggcggccctccagtgagaag

SEQ ID NO: 852093 - DNA, 20 bp, mouse
gtcctccagaggtgggtacc

SEQ ID NO: 852094 - DNA, 20 bp, mouse
ggagcgcatcctccagaggt

SEQ ID NO: 852095 - DNA, 20 bp, mouse
gcccatcaccccatgaacgc

SEQ ID NO: 852096 - DNA, 20 bp, mouse
gaaagcgcgggtctgagggg

SEQ ID NO: 852097 - DNA, 20 bp, mouse
gggggcgcgcgcgcaatccg

SEQ ID NO: 852098 - DNA, 20 bp, mouse
gcgcaatccgtggaagtctc

SEQ ID NO: 852099 - DNA, 20 bp, mouse
ggggccgcaggaaacaatag

SEQ ID NO: 852100 - DNA, 20 bp, mouse
ggactctcgagcgtctccat

SEQ ID NO: 852101 - DNA, 20 bp, mouse
gcgtggaagtctccggactg

SEQ ID NO: 852102 - DNA, 20 bp, mouse
ggaagtctccggactgtggt

SEQ ID NO: 852103 - DNA, 20 bp, mouse
gcagacccgcgctttctcat

SEQ ID NO: 852104 - DNA, 20 bp, mouse
gggtctggttagcaactcgg

SEQ ID NO: 852105 - DNA, 20 bp, mouse
gtggctgcgcatgagcgtgt

SEQ ID NO: 852106 - DNA, 20 bp, mouse
gcgcacagccaatgaggaga

SEQ ID NO: 852107 - DNA, 20 bp, mouse
gagttctggagtagcagtga

SEQ ID NO: 852108 - DNA, 20 bp, mouse
gcgcgtgcacgcgggacaac

SEQ ID NO: 852109 - DNA, 20 bp, mouse
gctacaagccgtctcctcat

SEQ ID NO: 852110 - DNA, 20 bp, mouse
gagccacgggctccgcagta

SEQ ID NO: 852111 - DNA, 20 bp, mouse
ggacggagggccggggcttg

SEQ ID NO: 852112 - DNA, 20 bp, mouse
ggacaaccgggtctgaagtc

SEQ ID NO: 852113 - DNA, 20 bp, mouse
gttggggagggcggcggaag

SEQ ID NO: 852114 - DNA, 20 bp, mouse
gccaatgcggccaggcacgg

SEQ ID NO: 852115 - DNA, 20 bp, mouse
gtcgtcccgccgcgcgaggt

SEQ ID NO: 852116 - DNA, 20 bp, mouse
gagaaaccgccggttctctt

SEQ ID NO: 852117 - DNA, 20 bp, mouse
gtctcttgggatttattgtc

SEQ ID NO: 852118 - DNA, 20 bp, mouse
gtaaatcccaagagaaccgg

SEQ ID NO: 852119 - DNA, 20 bp, mouse
gtagaacagaaggattaaag

SEQ ID NO: 852120 - DNA, 20 bp, mouse
gccaaaaaggctcgcgactt

SEQ ID NO: 852121 - DNA, 20 bp, mouse
gtgggagttttcaggttcta

SEQ ID NO: 852122 - DNA, 20 bp, mouse
gaggcatgatgggagttttc

SEQ ID NO: 852123 - DNA, 20 bp, mouse
gaggatctactagaaaccgc

SEQ ID NO: 852124 - DNA, 20 bp, mouse
gttcccgcctccaggcatga

SEQ ID NO: 852125 - DNA, 20 bp, mouse
gtgcagctgctttgcatttt

SEQ ID NO: 852126 - DNA, 20 bp, mouse
ggacaggggcggagctacta

SEQ ID NO: 852127 - DNA, 20 bp, mouse
ggggcggagctactaagggc

SEQ ID NO: 852128 - DNA, 20 bp, mouse
gagggtggttggaaaaacct

SEQ ID NO: 852129 - DNA, 20 bp, mouse
gcccacccgcgcggaccaat

SEQ ID NO: 852130 - DNA, 20 bp, mouse
gatgcggaggcattctaagc

SEQ ID NO: 852131 - DNA, 20 bp, mouse
gggaaggagagtccctcggg

SEQ ID NO: 852132 - DNA, 20 bp, mouse
ggccttctgccacctcccga

SEQ ID NO: 852133 - DNA, 20 bp, mouse
ggtagctgcggtttccaggg

SEQ ID NO: 852134 - DNA, 20 bp, mouse
gcaaaggcgtgtaaggatct

SEQ ID NO: 852135 - DNA, 20 bp, mouse
gagcctaaatgtggctgaag

SEQ ID NO: 852136 - DNA, 20 bp, mouse
gggaaaggccatctgctctc

SEQ ID NO: 852137 - DNA, 20 bp, mouse
gtgattcaaggtctaggcaa

SEQ ID NO: 852138 - DNA, 20 bp, mouse
gtccaaacattagacagtgt

SEQ ID NO: 852139 - DNA, 20 bp, mouse
gcctaaatcccaaaggggaa

SEQ ID NO: 852140 - DNA, 20 bp, mouse
gaaaatcagcttcttacccg

SEQ ID NO: 852141 - DNA, 20 bp, mouse
gacatctagagactgattca

SEQ ID NO: 852142 - DNA, 20 bp, mouse
gttacccgtggaatcttgtc

SEQ ID NO: 852143 - DNA, 20 bp, mouse
gtgttcctgacaagattcca

SEQ ID NO: 852144 - DNA, 20 bp, mouse
ggatttaggaacagcaaaac

SEQ ID NO: 852145 - DNA, 20 bp, mouse
gtgctcgccctgagagcaga

SEQ ID NO: 852146 - DNA, 20 bp, mouse
ggaaagccgccggggcagat

SEQ ID NO: 852147 - DNA, 20 bp, mouse
gccgccggggcagattgggt

SEQ ID NO: 852148 - DNA, 20 bp, mouse
gggagggagtgcggggaggt

SEQ ID NO: 852149 - DNA, 20 bp, mouse
gagcaatccgaaagccgccg

SEQ ID NO: 852150 - DNA, 20 bp, mouse
gagagcgcctgcgtggacgg

SEQ ID NO: 852151 - DNA, 20 bp, mouse
gccggggcagattgggttgg

SEQ ID NO: 852152 - DNA, 20 bp, mouse
ggagaccagagcaccgcctc

SEQ ID NO: 852153 - DNA, 20 bp, mouse
ggaagggtggagcccctaga

SEQ ID NO: 852154 - DNA, 20 bp, mouse
gccaggcaacgggataacag

SEQ ID NO: 852155 - DNA, 20 bp, mouse
gtcagcgtttcccttgggga

SEQ ID NO: 852156 - DNA, 20 bp, mouse
ggcggcagcagcaactacgg

SEQ ID NO: 852157 - DNA, 20 bp, mouse
ggtgatgcgcaaggcttgtt

SEQ ID NO: 852158 - DNA, 20 bp, mouse
gagaaaaggggctctgtcct

SEQ ID NO: 852159 - DNA, 20 bp, mouse
ggcgcccggaggggaggagt

SEQ ID NO: 852160 - DNA, 20 bp, mouse
gtgagggaggcgggagactt

SEQ ID NO: 852161 - DNA, 20 bp, mouse
gagcggagttccgggtccgg

SEQ ID NO: 852162 - DNA, 20 bp, mouse
ggggaggcgggagacttagg

SEQ ID NO: 852163 - DNA, 20 bp, mouse
gaggaagcggaagaaccgta

SEQ ID NO: 852164 - DNA, 20 bp, mouse
ggacccggaaacacactcta

SEQ ID NO: 852165 - DNA, 20 bp, mouse
gtacccccaaaacgtaggag

SEQ ID NO: 852166 - DNA, 20 bp, mouse
ggtcacggaggcacggggac

SEQ ID NO: 852167 - DNA, 20 bp, mouse
ggacccaagaagccatttta

SEQ ID NO: 852168 - DNA, 20 bp, mouse
gatagggtcacgtgtcacgg

SEQ ID NO: 852169 - DNA, 20 bp, mouse
gggaccggaatttctttctg

SEQ ID NO: 852170 - DNA, 20 bp, mouse
ggtcacgtgtcacggaggca

SEQ ID NO: 852171 - DNA, 20 bp, mouse
gaatggcttcttgggtcata

SEQ ID NO: 852172 - DNA, 20 bp, mouse
gcagccttaaaatggcttct

SEQ ID NO: 852173 - DNA, 20 bp, mouse
ggtcatagggtcacgtgtca

SEQ ID NO: 852174 - DNA, 20 bp, mouse
gacgcaaagcgcaggcattc

SEQ ID NO: 852175 - DNA, 20 bp, mouse
gccagcacgacgcaaagcgc

SEQ ID NO: 852176 - DNA, 20 bp, mouse
gggcgtggctagagatgctg

SEQ ID NO: 852177 - DNA, 20 bp, mouse
gcccctggccacacgaagtc

SEQ ID NO: 852178 - DNA, 20 bp, mouse
ggagccgcccagacttcgtg

SEQ ID NO: 852179 - DNA, 20 bp, mouse
gtggccacacgaagtctggg

SEQ ID NO: 852180 - DNA, 20 bp, mouse
gccccacggtaggtcggagc

SEQ ID NO: 852181 - DNA, 20 bp, mouse
ggacttgttcagaaacgggg

SEQ ID NO: 852182 - DNA, 20 bp, mouse
gcgggacttgttcagaaacg

SEQ ID NO: 852183 - DNA, 20 bp, mouse
ggccccgccccacggtaggt

SEQ ID NO: 852184 - DNA, 20 bp, mouse
gcagtcgggtggtacaagcc

SEQ ID NO: 852185 - DNA, 20 bp, mouse
gttcagaaacggggcggagc

SEQ ID NO: 852186 - DNA, 20 bp, mouse
gctctagagtagaatgcggg

SEQ ID NO: 852187 - DNA, 20 bp, mouse
gtagaatgcggggggagcaa

SEQ ID NO: 852188 - DNA, 20 bp, mouse
gggaaaaacacaaaatatac

SEQ ID NO: 852189 - DNA, 20 bp, mouse
gttcctctagagtagaatgc

SEQ ID NO: 852190 - DNA, 20 bp, mouse
gtctagatgaaatttcagta

SEQ ID NO: 852191 - DNA, 20 bp, mouse
gatcatatatagtaacattc

SEQ ID NO: 852192 - DNA, 20 bp, mouse
gtctttataccattgtaaac

SEQ ID NO: 852193 - DNA, 20 bp, mouse
gctgtacatggattccaaac

SEQ ID NO: 852194 - DNA, 20 bp, mouse
gtaactttagtatggtttta

SEQ ID NO: 852195 - DNA, 20 bp, mouse
gagtattaacaagacagatc

SEQ ID NO: 852196 - DNA, 20 bp, mouse
gggccgggaggggaatgcac

SEQ ID NO: 852197 - DNA, 20 bp, mouse
gaacccgggaggcttgggga

SEQ ID NO: 852198 - DNA, 20 bp, mouse
gcccctcccggcccaaccct

SEQ ID NO: 852199 - DNA, 20 bp, mouse
gggactagggaccctaccta

SEQ ID NO: 852200 - DNA, 20 bp, mouse
ggaggcgccgtcagggtcaa

SEQ ID NO: 852201 - DNA, 20 bp, mouse
gggagctgctgggacctgtc

SEQ ID NO: 852202 - DNA, 20 bp, mouse
gcgccgtcagggtcaagggt

SEQ ID NO: 852203 - DNA, 20 bp, mouse
ggctgccccgggcatgatct

SEQ ID NO: 852204 - DNA, 20 bp, mouse
gggaggggaatgcacgggca

SEQ ID NO: 852205 - DNA, 20 bp, mouse
gcccggcccaaccctaggta

SEQ ID NO: 852206 - DNA, 20 bp, mouse
ggcaccgcgaatggaatcgg

SEQ ID NO: 852207 - DNA, 20 bp, mouse
gagggcaaaagcaccgcgaa

SEQ ID NO: 852208 - DNA, 20 bp, mouse
ggctaagttcccactcctgg

SEQ ID NO: 852209 - DNA, 20 bp, mouse
gtgcgcaggaagtggagcgc

SEQ ID NO: 852210 - DNA, 20 bp, mouse
gaaagcaccgcgaatggaat

SEQ ID NO: 852211 - DNA, 20 bp, mouse
gaagaccatagactgtcaaa

SEQ ID NO: 852212 - DNA, 20 bp, mouse
gggacagccaggagtccaag

SEQ ID NO: 852213 - DNA, 20 bp, mouse
ggcctcctcccgggacagcc

SEQ ID NO: 852214 - DNA, 20 bp, mouse
ggaggcgcgtttgttttgca

SEQ ID NO: 852215 - DNA, 20 bp, mouse
gtctgcttgaagatgctcta

SEQ ID NO: 852216 - DNA, 20 bp, mouse
ggacacggagtcagcgtggg

SEQ ID NO: 852217 - DNA, 20 bp, mouse
ggcactctgtagcacctcaa

SEQ ID NO: 852218 - DNA, 20 bp, mouse
gtccccagaccttagtaaac

SEQ ID NO: 852219 - DNA, 20 bp, mouse
gccccctcgcgtccgacgcg

SEQ ID NO: 852220 - DNA, 20 bp, mouse
gggggacacggagtcagcgt

SEQ ID NO: 852221 - DNA, 20 bp, mouse
gccccgcctgggcctgaagc

SEQ ID NO: 852222 - DNA, 20 bp, mouse
gttactaaggtctggggaca

SEQ ID NO: 852223 - DNA, 20 bp, mouse
gtgccctcgcgtcggacgcg

SEQ ID NO: 852224 - DNA, 20 bp, mouse
ggtccgacgcgagggcagtg

SEQ ID NO: 852225 - DNA, 20 bp, mouse
gctccgcactgccctcgcgt

SEQ ID NO: 852226 - DNA, 20 bp, mouse
ggggtccggaacctgtgctc

SEQ ID NO: 852227 - DNA, 20 bp, mouse
gctctggcgaccactgctgg

SEQ ID NO: 852228 - DNA, 20 bp, mouse
gctggcgcccccgtgcaagt

SEQ ID NO: 852229 - DNA, 20 bp, mouse
gcgcgtgtgtgtcccgggca

SEQ ID NO: 852230 - DNA, 20 bp, mouse
ggcagtggtcgccagagcac

SEQ ID NO: 852231 - DNA, 20 bp, mouse
gtgctcagacgcatgcgcgt

SEQ ID NO: 852232 - DNA, 20 bp, mouse
gctggtggctcataggacga

SEQ ID NO: 852233 - DNA, 20 bp, mouse
gccgaagcctagaaagagga

SEQ ID NO: 852234 - DNA, 20 bp, mouse
gtaaccccaagtatcactat

SEQ ID NO: 852235 - DNA, 20 bp, mouse
gcataggacgatggcctacg

SEQ ID NO: 852236 - DNA, 20 bp, mouse
gtggatgagacgtgggaact

SEQ ID NO: 852237 - DNA, 20 bp, mouse
gagggggcgtggatgagacg

SEQ ID NO: 852238 - DNA, 20 bp, mouse
gtggagctgcgcgtgcgctc

SEQ ID NO: 852239 - DNA, 20 bp, mouse
gcggctgcgccgagccggga

SEQ ID NO: 852240 - DNA, 20 bp, mouse
gccaggggtctatacaagtg

SEQ ID NO: 852241 - DNA, 20 bp, mouse
gtcactcgcggtgctaatga

SEQ ID NO: 852242 - DNA, 20 bp, mouse
gggtctatacaagtgaggtg

SEQ ID NO: 852243 - DNA, 20 bp, mouse
gaaggacgaagccaagcaag

SEQ ID NO: 852244 - DNA, 20 bp, mouse
gtggcaagcgcctcaccaaa

SEQ ID NO: 852245 - DNA, 20 bp, mouse
ggggcttggcccatactgtt

SEQ ID NO: 852246 - DNA, 20 bp, mouse
gcgccaggaggcccgctaga

SEQ ID NO: 852247 - DNA, 20 bp, mouse
gctactgcgcaggctcaccg

SEQ ID NO: 852248 - DNA, 20 bp, mouse
gcaggaggcccgctagaggg

SEQ ID NO: 852249 - DNA, 20 bp, mouse
gtagagggcggggtcgacct

SEQ ID NO: 852250 - DNA, 20 bp, mouse
ggtcgaccccgccctctagc

SEQ ID NO: 852251 - DNA, 20 bp, mouse
gtccgcggcgcgcgctccca

SEQ ID NO: 852252 - DNA, 20 bp, mouse
gcaaggctctgctactgcgc

SEQ ID NO: 852253 - DNA, 20 bp, mouse
gaagagggcggggctagcga

SEQ ID NO: 852254 - DNA, 20 bp, mouse
gcggaggccggaaggaagtg

SEQ ID NO: 852255 - DNA, 20 bp, mouse
ggctagcgagggaagcccgc

SEQ ID NO: 852256 - DNA, 20 bp, mouse
gggaaatgatgcgcaggaat

SEQ ID NO: 852257 - DNA, 20 bp, mouse
gtcgccccggcaaccctgga

SEQ ID NO: 852258 - DNA, 20 bp, mouse
gtcttccgaggaacccccag

SEQ ID NO: 852259 - DNA, 20 bp, mouse
gtggtgcagaagccagattg

SEQ ID NO: 852260 - DNA, 20 bp, mouse
gcgtccttccagggttgccg

SEQ ID NO: 852261 - DNA, 20 bp, mouse
gtccaccgctgggggttcct

SEQ ID NO: 852262 - DNA, 20 bp, mouse
gtccgggcgcttcaagatga

SEQ ID NO: 852263 - DNA, 20 bp, mouse
gctgcgcatgcgtccttcca

SEQ ID NO: 852264 - DNA, 20 bp, mouse
gtccgaggaacccccagcgg

SEQ ID NO: 852265 - DNA, 20 bp, mouse
gccggaagtggcccgcaatc

SEQ ID NO: 852266 - DNA, 20 bp, mouse
ggccgggcagcgtcccccgt

SEQ ID NO: 852267 - DNA, 20 bp, mouse
ggggcagcgtcccccgtggg

SEQ ID NO: 852268 - DNA, 20 bp, mouse
gcagcgtcccccgtgggagg

SEQ ID NO: 852269 - DNA, 20 bp, mouse
gcctcccgctccctgacgac

SEQ ID NO: 852270 - DNA, 20 bp, mouse
gcgctccctgacgacaggtc

SEQ ID NO: 852271 - DNA, 20 bp, mouse
gtcctccccccctcccacgg

SEQ ID NO: 852272 - DNA, 20 bp, mouse
gggggcctgacctgtcgtca

SEQ ID NO: 852273 - DNA, 20 bp, mouse
ggaggaagggcggggtcggt

SEQ ID NO: 852274 - DNA, 20 bp, mouse
ggtggccgcgcggccgtcgg

SEQ ID NO: 852275 - DNA, 20 bp, mouse
ggggaacacggaggaggcga

SEQ ID NO: 852276 - DNA, 20 bp, mouse
ggcggaggcagcaatctgat

SEQ ID NO: 852277 - DNA, 20 bp, mouse
gcgcccctggaagtgattga

SEQ ID NO: 852278 - DNA, 20 bp, mouse
gaatacgctcgctgcggcag

SEQ ID NO: 852279 - DNA, 20 bp, mouse
ggccgcagcgagcgtattaa

SEQ ID NO: 852280 - DNA, 20 bp, mouse
gcggccctctcccagcccgc

SEQ ID NO: 852281 - DNA, 20 bp, mouse
gcaggcctgctgtgtccacc

SEQ ID NO: 852282 - DNA, 20 bp, mouse
gcagcaatctgatgggtgtg

SEQ ID NO: 852283 - DNA, 20 bp, mouse
gacaccttgcccgggactaa

SEQ ID NO: 852284 - DNA, 20 bp, mouse
ggcccgtcaatcacttccag

SEQ ID NO: 852285 - DNA, 20 bp, mouse
gtagtgcgctcggcaccggc

SEQ ID NO: 852286 - DNA, 20 bp, mouse
gacgtggcgcctccaacccc

SEQ ID NO: 852287 - DNA, 20 bp, mouse
ggccccgcaaacgctaccat

SEQ ID NO: 852288 - DNA, 20 bp, mouse
gcggaagcggcggcgatagg

SEQ ID NO: 852289 - DNA, 20 bp, mouse
gctgggcggccacacggaag

SEQ ID NO: 852290 - DNA, 20 bp, mouse
ggcgccgccccgagcgtcgc

SEQ ID NO: 852291 - DNA, 20 bp, mouse
gaccgcttggataccaaagt

SEQ ID NO: 852292 - DNA, 20 bp, mouse
ggcgccacgtcggggcctcg

SEQ ID NO: 852293 - DNA, 20 bp, mouse
gtatccaagcggtgtgggag

SEQ ID NO: 852294 - DNA, 20 bp, mouse
ggcgttgccagtgtcagccc

SEQ ID NO: 852295 - DNA, 20 bp, mouse
gcggcgataggcggaaccct

SEQ ID NO: 852296 - DNA, 20 bp, mouse
ggcgggctgcgcacctgggg

SEQ ID NO: 852297 - DNA, 20 bp, mouse
gggcaagccccccttcccag

SEQ ID NO: 852298 - DNA, 20 bp, mouse
ggctgcgcacctggggggga

SEQ ID NO: 852299 - DNA, 20 bp, mouse
gcccgggcgcgactaaagcg

SEQ ID NO: 852300 - DNA, 20 bp, mouse
ggctctctaggacccgagga

SEQ ID NO: 852301 - DNA, 20 bp, mouse
gggcatccctccactgggaa

SEQ ID NO: 852302 - DNA, 20 bp, mouse
ggaaatgcagaactgctaga

SEQ ID NO: 852303 - DNA, 20 bp, mouse
gttacgctcggtttgagggg

SEQ ID NO: 852304 - DNA, 20 bp, mouse
ggcggcgcgggctgcgcacc

SEQ ID NO: 852305 - DNA, 20 bp, mouse
gctttagtcgcgcccggggt

SEQ ID NO: 852306 - DNA, 20 bp, mouse
gcatgcgcagttctcaccgt

SEQ ID NO: 852307 - DNA, 20 bp, mouse
gagaactgcgcatgcgtggt

SEQ ID NO: 852308 - DNA, 20 bp, mouse
gcgcagttctcaccgttggt

SEQ ID NO: 852309 - DNA, 20 bp, mouse
gcgctcgcgctcatgttgct

SEQ ID NO: 852310 - DNA, 20 bp, mouse
ggctgcactaaggaacgaat

SEQ ID NO: 852311 - DNA, 20 bp, mouse
gtgagtgcagatgcccgcgg

SEQ ID NO: 852312 - DNA, 20 bp, mouse
gtgcgcatgcgtggtagggc

SEQ ID NO: 852313 - DNA, 20 bp, mouse
gccgaaagcctccccaccaa

SEQ ID NO: 852314 - DNA, 20 bp, mouse
ggttctcaccgttggtgggg

SEQ ID NO: 852315 - DNA, 20 bp, mouse
gtagggctggccaggtcgcg

SEQ ID NO: 852316 - DNA, 20 bp, mouse
ggagcattgacgacactcgg

SEQ ID NO: 852317 - DNA, 20 bp, mouse
gggcgagcattgacgacact

SEQ ID NO: 852318 - DNA, 20 bp, mouse
gtgaaggaacaggtggagct

SEQ ID NO: 852319 - DNA, 20 bp, mouse
gggaagcgagcgacgttagg

SEQ ID NO: 852320 - DNA, 20 bp, mouse
ggagagtgacgcatcctggg

SEQ ID NO: 852321 - DNA, 20 bp, mouse
ggctgggtggggctgatttg

SEQ ID NO: 852322 - DNA, 20 bp, mouse
ggcgcggtaccctcggttcc

SEQ ID NO: 852323 - DNA, 20 bp, mouse
gaaggacgttcgtgaggctc

SEQ ID NO: 852324 - DNA, 20 bp, mouse
gaccaggtctgctctttccg

SEQ ID NO: 852325 - DNA, 20 bp, mouse
gtaggcgggcaggtccgccg

SEQ ID NO: 852326 - DNA, 20 bp, mouse
gtgagcccctgcaacattcc

SEQ ID NO: 852327 - DNA, 20 bp, mouse
gtggcagataccggataaca

SEQ ID NO: 852328 - DNA, 20 bp, mouse
gagataccggataacaggga

SEQ ID NO: 852329 - DNA, 20 bp, mouse
gggagccaggaatgttgcag

SEQ ID NO: 852330 - DNA, 20 bp, mouse
gggagcctgcgagctgtagg

SEQ ID NO: 852331 - DNA, 20 bp, mouse
ggaagtggttctcccagcct

SEQ ID NO: 852332 - DNA, 20 bp, mouse
gaggtgctagctaacattcc

SEQ ID NO: 852333 - DNA, 20 bp, mouse
gcggtatctgccaggaaccc

SEQ ID NO: 852334 - DNA, 20 bp, mouse
gtgcagccctccctgttatc

SEQ ID NO: 852335 - DNA, 20 bp, mouse
ggctccggtcggggccgcgg

SEQ ID NO: 852336 - DNA, 20 bp, mouse
gcctgagcctaaacacgcga

SEQ ID NO: 852337 - DNA, 20 bp, mouse
gtgacctatcaaaatagtga

SEQ ID NO: 852338 - DNA, 20 bp, mouse
gggcaagccccaccttttct

SEQ ID NO: 852339 - DNA, 20 bp, mouse
gttgccgtcactattttgat

SEQ ID NO: 852340 - DNA, 20 bp, mouse
gcctaggattgtgtggttag

SEQ ID NO: 852341 - DNA, 20 bp, mouse
gggaacttgaaacccttcct

SEQ ID NO: 852342 - DNA, 20 bp, mouse
gtaatttaggagagtcggta

SEQ ID NO: 852343 - DNA, 20 bp, mouse
gatgtctctccagcttcagt

SEQ ID NO: 852344 - DNA, 20 bp, mouse
gactattttgataggtcaga

SEQ ID NO: 852345 - DNA, 20 bp, mouse
gctaaattacgttgttttcc

SEQ ID NO: 852346 - DNA, 20 bp, mouse
gccgctacaggaactggaac

SEQ ID NO: 852347 - DNA, 20 bp, mouse
gcggggctgaacaagaaaaa

SEQ ID NO: 852348 - DNA, 20 bp, mouse
gaggaaaccgagttggagga

SEQ ID NO: 852349 - DNA, 20 bp, mouse
gagctgtagtccacagttcc

SEQ ID NO: 852350 - DNA, 20 bp, mouse
gctggctggccccggaactg

SEQ ID NO: 852351 - DNA, 20 bp, mouse
gaaagtgccgctacaggaac

SEQ ID NO: 852352 - DNA, 20 bp, mouse
gggaacaggaatgctttgct

SEQ ID NO: 852353 - DNA, 20 bp, mouse
ggcggggggagcggcggaga

SEQ ID NO: 852354 - DNA, 20 bp, mouse
gtatcacaagactcggactc

SEQ ID NO: 852355 - DNA, 20 bp, mouse
ggaactgaaaaccggggcgg

SEQ ID NO: 852356 - DNA, 20 bp, mouse
gtgtgtgttcagtatgaata

SEQ ID NO: 852357 - DNA, 20 bp, mouse
gaagggtgatctcaaaccag

SEQ ID NO: 852358 - DNA, 20 bp, mouse
ggccccgcccaggaccgcag

SEQ ID NO: 852359 - DNA, 20 bp, mouse
gagtatgaatagggtcttga

SEQ ID NO: 852360 - DNA, 20 bp, mouse
ggacgggctcaattcagaag

SEQ ID NO: 852361 - DNA, 20 bp, mouse
gaacctctgcggtcctgggc

SEQ ID NO: 852362 - DNA, 20 bp, mouse
gaggaccgcagaggtttcta

SEQ ID NO: 852363 - DNA, 20 bp, mouse
gcatatgtattacagacccc

SEQ ID NO: 852364 - DNA, 20 bp, mouse
gggaaactagcaccggtggg

SEQ ID NO: 852365 - DNA, 20 bp, mouse
gtcaattcagaagaggctaa

SEQ ID NO: 852366 - DNA, 20 bp, mouse
gccagcctgggatcccgatt

SEQ ID NO: 852367 - DNA, 20 bp, mouse
gctgggatcccgattgggat

SEQ ID NO: 852368 - DNA, 20 bp, mouse
gcgcccggaaacaatgagga

SEQ ID NO: 852369 - DNA, 20 bp, mouse
gcaaacctcggcggaggagg

SEQ ID NO: 852370 - DNA, 20 bp, mouse
gagcccctgaacccagctct

SEQ ID NO: 852371 - DNA, 20 bp, mouse
gtgggaggagatagcctcgg

SEQ ID NO: 852372 - DNA, 20 bp, mouse
gagcacccgtcaaacctcgg

SEQ ID NO: 852373 - DNA, 20 bp, mouse
gcggtcgcccggaaacaatg

SEQ ID NO: 852374 - DNA, 20 bp, mouse
gaggaggacccgctgagggg

SEQ ID NO: 852375 - DNA, 20 bp, mouse
gagtggcgcccggccgaggg

SEQ ID NO: 852376 - DNA, 20 bp, mouse
gcgggaggagggtatgcaac

SEQ ID NO: 852377 - DNA, 20 bp, mouse
gtaaactcgcccagcaccac

SEQ ID NO: 852378 - DNA, 20 bp, mouse
ggagggtatgcaacaggctc

SEQ ID NO: 852379 - DNA, 20 bp, mouse
ggaaagagtcacaatcgcag

SEQ ID NO: 852380 - DNA, 20 bp, mouse
gggcccaaagcccaagggtt

SEQ ID NO: 852381 - DNA, 20 bp, mouse
gcaaagcccaagggttcggg

SEQ ID NO: 852382 - DNA, 20 bp, mouse
gagcccaagggttcgggtgg

SEQ ID NO: 852383 - DNA, 20 bp, mouse
gctagcggcccaaagcccaa

SEQ ID NO: 852384 - DNA, 20 bp, mouse
gttcccccacccgaaccctt

SEQ ID NO: 852385 - DNA, 20 bp, mouse
gggcctcgagacacaatttt

SEQ ID NO: 852386 - DNA, 20 bp, mouse
gtaggtggtgagatgatatc

SEQ ID NO: 852387 - DNA, 20 bp, mouse
gctagcactcatgatgccca

SEQ ID NO: 852388 - DNA, 20 bp, mouse
gaataaaatagaaaagtgtg

SEQ ID NO: 852389 - DNA, 20 bp, mouse
gagatgatatcgggatgtct

SEQ ID NO: 852390 - DNA, 20 bp, mouse
gttcaagacgaggctggagt

SEQ ID NO: 852391 - DNA, 20 bp, mouse
gcctgtgccaccacatctaa

SEQ ID NO: 852392 - DNA, 20 bp, mouse
ggtgatgtacgtggccattg

SEQ ID NO: 852393 - DNA, 20 bp, mouse
gaagctcattaacgtcacag

SEQ ID NO: 852394 - DNA, 20 bp, mouse
ggctttgcacacggcctcaa

SEQ ID NO: 852395 - DNA, 20 bp, mouse
gcttgagttcaagacgaggc

SEQ ID NO: 852396 - DNA, 20 bp, mouse
gcggaccggcgctaggggat

SEQ ID NO: 852397 - DNA, 20 bp, mouse
gcagccgcggccagcggagt

SEQ ID NO: 852398 - DNA, 20 bp, mouse
gccctgcggaccggcgctag

SEQ ID NO: 852399 - DNA, 20 bp, mouse
gctaggcgccgcctcagaga

SEQ ID NO: 852400 - DNA, 20 bp, mouse
ggggattggtcggtgggaat

SEQ ID NO: 852401 - DNA, 20 bp, mouse
ggatcgacagtccatctctg

SEQ ID NO: 852402 - DNA, 20 bp, mouse
gcggcctggccaattggcgt

SEQ ID NO: 852403 - DNA, 20 bp, mouse
ggggcgggctcggacagccc

SEQ ID NO: 852404 - DNA, 20 bp, mouse
gatggactgtcgatcacgtc

SEQ ID NO: 852405 - DNA, 20 bp, mouse
gcgcagggggcgggcacagg

SEQ ID NO: 852406 - DNA, 20 bp, mouse
gccagctaggctttggccag

SEQ ID NO: 852407 - DNA, 20 bp, mouse
gcgcctctgctgtgaggcta

SEQ ID NO: 852408 - DNA, 20 bp, mouse
gagctgtggagaacccgtcg

SEQ ID NO: 852409 - DNA, 20 bp, mouse
gagaacctgcagcagataga

SEQ ID NO: 852410 - DNA, 20 bp, mouse
gaccccccaaaagatagaaa

SEQ ID NO: 852411 - DNA, 20 bp, mouse
gagaacccgtcgcggttgtg

SEQ ID NO: 852412 - DNA, 20 bp, mouse
gggagagaaaagcataagag

SEQ ID NO: 852413 - DNA, 20 bp, mouse
gggccgtagcctcacagcag

SEQ ID NO: 852414 - DNA, 20 bp, mouse
ggaaaagcataagaggggtg

SEQ ID NO: 852415 - DNA, 20 bp, mouse
gacacaccccacaaccgcga

SEQ ID NO: 852416 - DNA, 20 bp, mouse
gtaaccgcgccgccgaccgg

SEQ ID NO: 852417 - DNA, 20 bp, mouse
gcgggcgcgcagtgcatcgt

SEQ ID NO: 852418 - DNA, 20 bp, mouse
gtcggcggcgcggttagtgg

SEQ ID NO: 852419 - DNA, 20 bp, mouse
gagaaggcgactctgggatt

SEQ ID NO: 852420 - DNA, 20 bp, mouse
gtcctccagaacttccggag

SEQ ID NO: 852421 - DNA, 20 bp, mouse
ggccgcttgacgggaaccag

SEQ ID NO: 852422 - DNA, 20 bp, mouse
ggtcacgagaaggcgactct

SEQ ID NO: 852423 - DNA, 20 bp, mouse
gtcctctccggaagttctgg

SEQ ID NO: 852424 - DNA, 20 bp, mouse
gatcgagcagcagaagcgta

SEQ ID NO: 852425 - DNA, 20 bp, mouse
gggcttctaacatttccttc

SEQ ID NO: 852426 - DNA, 20 bp, mouse
gtccctgcaaagcctgggcc

SEQ ID NO: 852427 - DNA, 20 bp, mouse
ggggctgcggcagactggcg

SEQ ID NO: 852428 - DNA, 20 bp, mouse
gtggtcgcaaagcatcggag

SEQ ID NO: 852429 - DNA, 20 bp, mouse
gcggcctccctgcaaagcct

SEQ ID NO: 852430 - DNA, 20 bp, mouse
gtctagcaggttcccccctc

SEQ ID NO: 852431 - DNA, 20 bp, mouse
ggctaatgcctgccagaggg

SEQ ID NO: 852432 - DNA, 20 bp, mouse
gtgccgcagccccctctagc

SEQ ID NO: 852433 - DNA, 20 bp, mouse
gagagggggctgcggcagac

SEQ ID NO: 852434 - DNA, 20 bp, mouse
gagccaaagcagaaggcgat

SEQ ID NO: 852435 - DNA, 20 bp, mouse
ggcatctggtcgcaaagcat

SEQ ID NO: 852436 - DNA, 20 bp, mouse
gaagtgggcgaggttcgcgt

SEQ ID NO: 852437 - DNA, 20 bp, mouse
gaggcggggcgtgaccgcga

SEQ ID NO: 852438 - DNA, 20 bp, mouse
gcgtggcttctcagagaggg

SEQ ID NO: 852439 - DNA, 20 bp, mouse
gtgggcgtggcttctcagag

SEQ ID NO: 852440 - DNA, 20 bp, mouse
gggcccggagcggcagaagt

SEQ ID NO: 852441 - DNA, 20 bp, mouse
gtgccagcgccggctcgaga

SEQ ID NO: 852442 - DNA, 20 bp, mouse
gcagagagggcggctcccgg

SEQ ID NO: 852443 - DNA, 20 bp, mouse
ggaggaggagcagcggggct

SEQ ID NO: 852444 - DNA, 20 bp, mouse
gcgcacggggctggcggtga

SEQ ID NO: 852445 - DNA, 20 bp, mouse
ggacgcggaaaggcggaagg

SEQ ID NO: 852446 - DNA, 20 bp, mouse
gcctccggggaccgctccta

SEQ ID NO: 852447 - DNA, 20 bp, mouse
gccaccctaggagcggtccc

SEQ ID NO: 852448 - DNA, 20 bp, mouse
gcccggaggggtcagcgcag

SEQ ID NO: 852449 - DNA, 20 bp, mouse
gagcgaggataggaccgaac

SEQ ID NO: 852450 - DNA, 20 bp, mouse
gaggaccgaactggccgggg

SEQ ID NO: 852451 - DNA, 20 bp, mouse
ggaggcagatagcggatccc

SEQ ID NO: 852452 - DNA, 20 bp, mouse
gaggataggaccgaactggc

SEQ ID NO: 852453 - DNA, 20 bp, mouse
gatagccgtcggggccgggg

SEQ ID NO: 852454 - DNA, 20 bp, mouse
gacgcggggcggatagccgt

SEQ ID NO: 852455 - DNA, 20 bp, mouse
ggcctctgcgctgacccctc

SEQ ID NO: 852456 - DNA, 20 bp, mouse
gaattcgtgccggccggaga

SEQ ID NO: 852457 - DNA, 20 bp, mouse
gggtcaagacgagccgtctc

SEQ ID NO: 852458 - DNA, 20 bp, mouse
gccggctcgcctcccctctg

SEQ ID NO: 852459 - DNA, 20 bp, mouse
gcgggcgctcgtccgcagag

SEQ ID NO: 852460 - DNA, 20 bp, mouse
gcccgccctaccgctctcga

SEQ ID NO: 852461 - DNA, 20 bp, mouse
gcgcaagacttccaagaggg

SEQ ID NO: 852462 - DNA, 20 bp, mouse
ggcgctcgtccgcagagggg

SEQ ID NO: 852463 - DNA, 20 bp, mouse
gaagccctcacagtgcgcgc

SEQ ID NO: 852464 - DNA, 20 bp, mouse
gctctgaaacccgacgcttc

SEQ ID NO: 852465 - DNA, 20 bp, mouse
gggcggaagccagaagcgtc

SEQ ID NO: 852466 - DNA, 20 bp, mouse
gaggacgcgtggggcgctgt

SEQ ID NO: 852467 - DNA, 20 bp, mouse
gcacacccgtgggggttctg

SEQ ID NO: 852468 - DNA, 20 bp, mouse
ggcctctgtcccaaccaagg

SEQ ID NO: 852469 - DNA, 20 bp, mouse
gggctcctccaggacgcgtg

SEQ ID NO: 852470 - DNA, 20 bp, mouse
gagcgccccacgcgtcctgg

SEQ ID NO: 852471 - DNA, 20 bp, mouse
gcaagagagcacctataacc

SEQ ID NO: 852472 - DNA, 20 bp, mouse
ggacttcggcagaaagatgg

SEQ ID NO: 852473 - DNA, 20 bp, mouse
gctcactctgggtctgacgg

SEQ ID NO: 852474 - DNA, 20 bp, mouse
gacggcggcatggctcctcc

SEQ ID NO: 852475 - DNA, 20 bp, mouse
gaaagcctctgtcccaacca

SEQ ID NO: 852476 - DNA, 20 bp, mouse
gaggatgctgcgccaatgtg

SEQ ID NO: 852477 - DNA, 20 bp, mouse
ggggacactcgggactgagt

SEQ ID NO: 852478 - DNA, 20 bp, mouse
gtctcagtgtggatagagta

SEQ ID NO: 852479 - DNA, 20 bp, mouse
gcttctagctcggaactgtg

SEQ ID NO: 852480 - DNA, 20 bp, mouse
ggagagttggaacgtgttct

SEQ ID NO: 852481 - DNA, 20 bp, mouse
ggcttcgtgcactcagtcct

SEQ ID NO: 852482 - DNA, 20 bp, mouse
gaacgtagctattttgagta

SEQ ID NO: 852483 - DNA, 20 bp, mouse
gcgggactgagtaggtagac

SEQ ID NO: 852484 - DNA, 20 bp, mouse
gtcctactttccttctagct

SEQ ID NO: 852485 - DNA, 20 bp, mouse
gctacgttacagaggagagt

SEQ ID NO: 852486 - DNA, 20 bp, mouse
gagccacagaggggcgtcgg

SEQ ID NO: 852487 - DNA, 20 bp, mouse
gccggcgctgggaggaacct

SEQ ID NO: 852488 - DNA, 20 bp, mouse
gactgggcgacggatctcgc

SEQ ID NO: 852489 - DNA, 20 bp, mouse
gccgtctcattgtgcgcgat

SEQ ID NO: 852490 - DNA, 20 bp, mouse
ggggtgcgggcgcagaggtc

SEQ ID NO: 852491 - DNA, 20 bp, mouse
gagcagccacagaggggcgt

SEQ ID NO: 852492 - DNA, 20 bp, mouse
ggggcccggacaggaagcgg

SEQ ID NO: 852493 - DNA, 20 bp, mouse
gcggatctcgcaggtagcta

SEQ ID NO: 852494 - DNA, 20 bp, mouse
gtgaggagccgggcccggac

SEQ ID NO: 852495 - DNA, 20 bp, mouse
ggcgcgcttccggccagccg

SEQ ID NO: 852496 - DNA, 20 bp, mouse
gtataggcggagaaaacaaa

SEQ ID NO: 852497 - DNA, 20 bp, mouse
gggaggagaaggtacttccg

SEQ ID NO: 852498 - DNA, 20 bp, mouse
gggaggggcgaggacaaatg

SEQ ID NO: 852499 - DNA, 20 bp, mouse
gcgcgtccgcgcggactcca

SEQ ID NO: 852500 - DNA, 20 bp, mouse
gctcggaggactcgcgggtt

SEQ ID NO: 852501 - DNA, 20 bp, mouse
gcaaacacaaagtttatagg

SEQ ID NO: 852502 - DNA, 20 bp, mouse
gatgcgctcggaggactcgc

SEQ ID NO: 852503 - DNA, 20 bp, mouse
gggcgaggacaaatgaggta

SEQ ID NO: 852504 - DNA, 20 bp, mouse
ggaccggaccaaggtatcat

SEQ ID NO: 852505 - DNA, 20 bp, mouse
ggcgttacgcatgcgctcgg

SEQ ID NO: 852506 - DNA, 20 bp, mouse
gcccagaatgccacgctctg

SEQ ID NO: 852507 - DNA, 20 bp, mouse
gaggcctccaaagccgtcta

SEQ ID NO: 852508 - DNA, 20 bp, mouse
gccacgctctgtggcccatt

SEQ ID NO: 852509 - DNA, 20 bp, mouse
gacccgcccctagacggctt

SEQ ID NO: 852510 - DNA, 20 bp, mouse
gtcggaaagaggcatgaggg

SEQ ID NO: 852511 - DNA, 20 bp, mouse
gctcatgcctctttccgaat

SEQ ID NO: 852512 - DNA, 20 bp, mouse
gaggccagagccgctctccc

SEQ ID NO: 852513 - DNA, 20 bp, mouse
gcctccagggagagcggctc

SEQ ID NO: 852514 - DNA, 20 bp, mouse
gctgtggcccattcggaaag

SEQ ID NO: 852515 - DNA, 20 bp, mouse
gctccaaagccgtctagggg

SEQ ID NO: 852516 - DNA, 20 bp, mouse
gaatgagcgcccagtctgtg

SEQ ID NO: 852517 - DNA, 20 bp, mouse
ggtgcagtctagatgacgga

SEQ ID NO: 852518 - DNA, 20 bp, mouse
gagatcgcggccatagagac

SEQ ID NO: 852519 - DNA, 20 bp, mouse
gcggaagtgacgcgtggaga

SEQ ID NO: 852520 - DNA, 20 bp, mouse
gttctgggaccgcacagact

SEQ ID NO: 852521 - DNA, 20 bp, mouse
ggggaagcgtgaggtgtttg

SEQ ID NO: 852522 - DNA, 20 bp, mouse
gagatgacggaaggactctt

SEQ ID NO: 852523 - DNA, 20 bp, mouse
gcgtggagacggtgcacttc

SEQ ID NO: 852524 - DNA, 20 bp, mouse
gcgctcattatctttgtgtc

SEQ ID NO: 852525 - DNA, 20 bp, mouse
gggtgcacttccggtctcta

SEQ ID NO: 852526 - DNA, 20 bp, mouse
ggcttcgcgggtttcaccgg

SEQ ID NO: 852527 - DNA, 20 bp, mouse
gagcgagtggctctccgcag

SEQ ID NO: 852528 - DNA, 20 bp, mouse
gcgcgccggaagtgccttta

SEQ ID NO: 852529 - DNA, 20 bp, mouse
ggctctccgcagaggcgcga

SEQ ID NO: 852530 - DNA, 20 bp, mouse
ggaggcgcgaggggcgcatg

SEQ ID NO: 852531 - DNA, 20 bp, mouse
gtgggacgtaggtgagcgag

SEQ ID NO: 852532 - DNA, 20 bp, mouse
gtgcgcccctcgcgcctctg

SEQ ID NO: 852533 - DNA, 20 bp, mouse
gctccggcccggggccgtcg

SEQ ID NO: 852534 - DNA, 20 bp, mouse
gagcggacgtctggcttcgc

SEQ ID NO: 852535 - DNA, 20 bp, mouse
gtcctagtggaacctggaga

SEQ ID NO: 852536 - DNA, 20 bp, mouse
ggcgcttcgcaggatattat

SEQ ID NO: 852537 - DNA, 20 bp, mouse
ggcctgacgtaggtgtaggg

SEQ ID NO: 852538 - DNA, 20 bp, mouse
gtcgcaggatattatggggg

SEQ ID NO: 852539 - DNA, 20 bp, mouse
gggaaagagaaagcgatttg

SEQ ID NO: 852540 - DNA, 20 bp, mouse
ggaggcctgacgtaggtgta

SEQ ID NO: 852541 - DNA, 20 bp, mouse
gagcactgtagaggcaaggg

SEQ ID NO: 852542 - DNA, 20 bp, mouse
gggagtgatagcacgaaaac

SEQ ID NO: 852543 - DNA, 20 bp, mouse
gtcaggaaagagcactgtag

SEQ ID NO: 852544 - DNA, 20 bp, mouse
ggtgacgacaactaaaaggt

SEQ ID NO: 852545 - DNA, 20 bp, mouse
ggagggtgacgacaactaaa

SEQ ID NO: 852546 - DNA, 20 bp, mouse
gctgccaggagcgtaggatt

SEQ ID NO: 852547 - DNA, 20 bp, mouse
gctgcccaatcctacgctcc

SEQ ID NO: 852548 - DNA, 20 bp, mouse
gtcttctctgccaggagcgt

SEQ ID NO: 852549 - DNA, 20 bp, mouse
gctcagaagtgaatcaaatc

SEQ ID NO: 852550 - DNA, 20 bp, mouse
gctcaactagattatcctca

SEQ ID NO: 852551 - DNA, 20 bp, mouse
gtggacaaatctaccccatg

SEQ ID NO: 852552 - DNA, 20 bp, mouse
gaaaaagaatacagattcaa

SEQ ID NO: 852553 - DNA, 20 bp, mouse
gataaaagaaattcttcttg

SEQ ID NO: 852554 - DNA, 20 bp, mouse
gtctgctgtgttactgttac

SEQ ID NO: 852555 - DNA, 20 bp, mouse
gcagacacatcttctctgcc

SEQ ID NO: 852556 - DNA, 20 bp, mouse
gccgggccgtgcgtcagaag

SEQ ID NO: 852557 - DNA, 20 bp, mouse
ggaagtgtgcgctttaagag

SEQ ID NO: 852558 - DNA, 20 bp, mouse
gcgaatcagagcttggggtt

SEQ ID NO: 852559 - DNA, 20 bp, mouse
gctttaagagcgggaggaag

SEQ ID NO: 852560 - DNA, 20 bp, mouse
gcccgcccgaatcagagctt

SEQ ID NO: 852561 - DNA, 20 bp, mouse
ggaaggggctcgcagcggcg

SEQ ID NO: 852562 - DNA, 20 bp, mouse
gcgcgtggggcggcgcctgc

SEQ ID NO: 852563 - DNA, 20 bp, mouse
ggcagctctgacgtcagcga

SEQ ID NO: 852564 - DNA, 20 bp, mouse
gtaaagcgcacacttcctgc

SEQ ID NO: 852565 - DNA, 20 bp, mouse
gcgaagcaacatgtgaattc

SEQ ID NO: 852566 - DNA, 20 bp, mouse
gtatgggggaaaatgagagt

SEQ ID NO: 852567 - DNA, 20 bp, mouse
gtccctgtgaaaggttatgg

SEQ ID NO: 852568 - DNA, 20 bp, mouse
gtcccccataacctttcaca

SEQ ID NO: 852569 - DNA, 20 bp, mouse
gcgcaggagcatcgtggctc

SEQ ID NO: 852570 - DNA, 20 bp, mouse
gccgcgctgcgtcacttcgc

SEQ ID NO: 852571 - DNA, 20 bp, mouse
gtcacttcgcaggagcatcg

SEQ ID NO: 852572 - DNA, 20 bp, mouse
ggaactacggcgccccacag

SEQ ID NO: 852573 - DNA, 20 bp, mouse
gtgggcatgctttagagtca

SEQ ID NO: 852574 - DNA, 20 bp, mouse
gtggaagacaaattgtagat

SEQ ID NO: 852575 - DNA, 20 bp, mouse
ggaagaccccaactaatcta

SEQ ID NO: 852576 - DNA, 20 bp, mouse
gcacaggtggggactccgaa

SEQ ID NO: 852577 - DNA, 20 bp, mouse
gaatagaggtgtatggctag

SEQ ID NO: 852578 - DNA, 20 bp, mouse
gcaaggagacgacctactgc

SEQ ID NO: 852579 - DNA, 20 bp, mouse
ggctagtggttagcatagat

SEQ ID NO: 852580 - DNA, 20 bp, mouse
gaaggacataggcttgtgtg

SEQ ID NO: 852581 - DNA, 20 bp, mouse
gtagctggttcccacaggtg

SEQ ID NO: 852582 - DNA, 20 bp, mouse
ggccacaagccctgcaacca

SEQ ID NO: 852583 - DNA, 20 bp, mouse
gcccactgaagagactgaat

SEQ ID NO: 852584 - DNA, 20 bp, mouse
ggatacagaacaccatgaaa

SEQ ID NO: 852585 - DNA, 20 bp, mouse
gttcagtgggtagtgaagct

SEQ ID NO: 852586 - DNA, 20 bp, mouse
gtgcccgaggaggctgaagg

SEQ ID NO: 852587 - DNA, 20 bp, mouse
gcccacaggaggcggagtta

SEQ ID NO: 852588 - DNA, 20 bp, mouse
gggccaacaggtgcccgagg

SEQ ID NO: 852589 - DNA, 20 bp, mouse
gaagaagcgcgcagaaggtg

SEQ ID NO: 852590 - DNA, 20 bp, mouse
gggcggagttagggagttgt

SEQ ID NO: 852591 - DNA, 20 bp, mouse
ggctcagggaggctgtctat

SEQ ID NO: 852592 - DNA, 20 bp, mouse
ggcctccggggatcaaagat

SEQ ID NO: 852593 - DNA, 20 bp, mouse
gggggtggggttgtcttcgg

SEQ ID NO: 852594 - DNA, 20 bp, mouse
ggctgcagcaacgcggggat

SEQ ID NO: 852595 - DNA, 20 bp, mouse
gggcggcccctcaggccaac

SEQ ID NO: 852596 - DNA, 20 bp, mouse
gccacccttggcaccactta

SEQ ID NO: 852597 - DNA, 20 bp, mouse
gggaaccctaagtggtgcca

SEQ ID NO: 852598 - DNA, 20 bp, mouse
gaggatgcgcgcagttagga

SEQ ID NO: 852599 - DNA, 20 bp, mouse
gtgagagagagatcggggat

SEQ ID NO: 852600 - DNA, 20 bp, mouse
gcccgatctctctctcacgg

SEQ ID NO: 852601 - DNA, 20 bp, mouse
ggccggaagtgggcgagagg

SEQ ID NO: 852602 - DNA, 20 bp, mouse
gagttgagaagattgaggtg

SEQ ID NO: 852603 - DNA, 20 bp, mouse
gcgagccggaagtgggcgag

SEQ ID NO: 852604 - DNA, 20 bp, mouse
gaaagaacatagcgggggcg

SEQ ID NO: 852605 - DNA, 20 bp, mouse
gcccactcagaaggctctac

SEQ ID NO: 852606 - DNA, 20 bp, mouse
gcaaggctcggggactgtgc

SEQ ID NO: 852607 - DNA, 20 bp, mouse
gatactggggcagggaccca

SEQ ID NO: 852608 - DNA, 20 bp, mouse
ggggccagagcgcaaggctc

SEQ ID NO: 852609 - DNA, 20 bp, mouse
gcatggcgcctcagcaccga

SEQ ID NO: 852610 - DNA, 20 bp, mouse
gtgcccaggcttcactggca

SEQ ID NO: 852611 - DNA, 20 bp, mouse
gaacgcggggctaaggccga

SEQ ID NO: 852612 - DNA, 20 bp, mouse
ggcctggcgcgcccggagga

SEQ ID NO: 852613 - DNA, 20 bp, mouse
ggagaccgggaataatccgg

SEQ ID NO: 852614 - DNA, 20 bp, mouse
ggctctggcccggggatact

SEQ ID NO: 852615 - DNA, 20 bp, mouse
gcctctacggggttctccac

SEQ ID NO: 852616 - DNA, 20 bp, mouse
gaggccagcggtgccagacg

SEQ ID NO: 852617 - DNA, 20 bp, mouse
gccaggccgcaggactcaca

SEQ ID NO: 852618 - DNA, 20 bp, mouse
ggcagccccacaggtggcag

SEQ ID NO: 852619 - DNA, 20 bp, mouse
ggcgccccgtctggcaccgc

SEQ ID NO: 852620 - DNA, 20 bp, mouse
gcgagccgctgccacctgtg

SEQ ID NO: 852621 - DNA, 20 bp, mouse
gcagtgcagtaaaggcagat

SEQ ID NO: 852622 - DNA, 20 bp, mouse
ggctcagaggaagtggttgg

SEQ ID NO: 852623 - DNA, 20 bp, mouse
gggtggcagcggctcgagga

SEQ ID NO: 852624 - DNA, 20 bp, mouse
gggaaggagtgccctgtcaa

SEQ ID NO: 852625 - DNA, 20 bp, mouse
gccgccgcccaagcagatcc

SEQ ID NO: 852626 - DNA, 20 bp, mouse
ggggagaccaaagcgttctg

SEQ ID NO: 852627 - DNA, 20 bp, mouse
gaaccaagacgacttctcat

SEQ ID NO: 852628 - DNA, 20 bp, mouse
gctcgctcttacaccccgtg

SEQ ID NO: 852629 - DNA, 20 bp, mouse
gcccaaggaccggaactcaa

SEQ ID NO: 852630 - DNA, 20 bp, mouse
gtgccccgggacagatctct

SEQ ID NO: 852631 - DNA, 20 bp, mouse
gcggagaccgctcacttacc

SEQ ID NO: 852632 - DNA, 20 bp, mouse
gttacaccccgtgcggtcga

SEQ ID NO: 852633 - DNA, 20 bp, mouse
gcggggatgcagtacctcac

SEQ ID NO: 852634 - DNA, 20 bp, mouse
gcttgccaccatccacaacc

SEQ ID NO: 852635 - DNA, 20 bp, mouse
gcgggcggacgcgtctttgg

SEQ ID NO: 852636 - DNA, 20 bp, mouse
gcgagcgcgagcccggatga

SEQ ID NO: 852637 - DNA, 20 bp, mouse
gcgggccggcgcacgcgcat

SEQ ID NO: 852638 - DNA, 20 bp, mouse
gggctgagggggcgtcccgg

SEQ ID NO: 852639 - DNA, 20 bp, mouse
gtgtccccgaggcacaggtg

SEQ ID NO: 852640 - DNA, 20 bp, mouse
gccaacgcggtccgctgccc

SEQ ID NO: 852641 - DNA, 20 bp, mouse
gggtcccgatgcgcgtgcgc

SEQ ID NO: 852642 - DNA, 20 bp, mouse
ggtcgcgcgcggcctttccc

SEQ ID NO: 852643 - DNA, 20 bp, mouse
gagcccttccagcccttgga

SEQ ID NO: 852644 - DNA, 20 bp, mouse
gcggggctcggcaaggcgga

SEQ ID NO: 852645 - DNA, 20 bp, mouse
gcgcgccctccgcggcggga

SEQ ID NO: 852646 - DNA, 20 bp, mouse
gcaggctcgcccacctctga

SEQ ID NO: 852647 - DNA, 20 bp, mouse
gtctgcagatgcggcctcca

SEQ ID NO: 852648 - DNA, 20 bp, mouse
gtctgagggcaagctggtaa

SEQ ID NO: 852649 - DNA, 20 bp, mouse
gtgagagcaccggcagctga

SEQ ID NO: 852650 - DNA, 20 bp, mouse
ggggacagctcaggcactcc

SEQ ID NO: 852651 - DNA, 20 bp, mouse
gccggcagctgagggagccc

SEQ ID NO: 852652 - DNA, 20 bp, mouse
gaatctctgactcctaaggc

SEQ ID NO: 852653 - DNA, 20 bp, mouse
gcgcctcctgcgcccagccc

SEQ ID NO: 852654 - DNA, 20 bp, mouse
ggcgctgcggagcgagccgg

SEQ ID NO: 852655 - DNA, 20 bp, mouse
gcgggcaggcaggctcgctc

SEQ ID NO: 852656 - DNA, 20 bp, mouse
ggaagcacatggcaggactg

SEQ ID NO: 852657 - DNA, 20 bp, mouse
gggcttcagcacctgaattc

SEQ ID NO: 852658 - DNA, 20 bp, mouse
gactggggctccttggactc

SEQ ID NO: 852659 - DNA, 20 bp, mouse
gagcaggaagagggttggta

SEQ ID NO: 852660 - DNA, 20 bp, mouse
gtggcaggactggggctcct

SEQ ID NO: 852661 - DNA, 20 bp, mouse
gccttggactctggcgtgag

SEQ ID NO: 852662 - DNA, 20 bp, mouse
gtctcaatgtgatgtcacag

SEQ ID NO: 852663 - DNA, 20 bp, mouse
gaggtctctagcacaccaaa

SEQ ID NO: 852664 - DNA, 20 bp, mouse
gtctggcgtgagtggtgagc

SEQ ID NO: 852665 - DNA, 20 bp, mouse
gacaactccaaggaagcaca

SEQ ID NO: 852666 - DNA, 20 bp, mouse
gcgggtagccgagagtccga

SEQ ID NO: 852667 - DNA, 20 bp, mouse
ggatccagggccaagtgcag

SEQ ID NO: 852668 - DNA, 20 bp, mouse
gacctcgagcgcccctgcgg

SEQ ID NO: 852669 - DNA, 20 bp, mouse
gcagcccgccgcgcagtggg

SEQ ID NO: 852670 - DNA, 20 bp, mouse
gtgcaggggcgggagggcca

SEQ ID NO: 852671 - DNA, 20 bp, mouse
ggatccctgcacccgcccga

SEQ ID NO: 852672 - DNA, 20 bp, mouse
ggccaccgcaggggcgctcg

SEQ ID NO: 852673 - DNA, 20 bp, mouse
gccagggcgcggatcggagg

SEQ ID NO: 852674 - DNA, 20 bp, mouse
gcagccgcaagccactccca

SEQ ID NO: 852675 - DNA, 20 bp, mouse
gtacccgtgcgcccttgccc

SEQ ID NO: 852676 - DNA, 20 bp, mouse
ggagcggcaggatgcggggc

SEQ ID NO: 852677 - DNA, 20 bp, mouse
gtcgcagcgggatgagaggc

SEQ ID NO: 852678 - DNA, 20 bp, mouse
gcacccccaaatcccatggg

SEQ ID NO: 852679 - DNA, 20 bp, mouse
gtacccggccgaaggaggcg

SEQ ID NO: 852680 - DNA, 20 bp, mouse
gccgccgcaagcagtggcga

SEQ ID NO: 852681 - DNA, 20 bp, mouse
gatcccgctgcgagctgtga

SEQ ID NO: 852682 - DNA, 20 bp, mouse
gcgcgcctggcaatccccgt

SEQ ID NO: 852683 - DNA, 20 bp, mouse
gcccctcccggcgcctggac

SEQ ID NO: 852684 - DNA, 20 bp, mouse
ggggcccgagggcggggtca

SEQ ID NO: 852685 - DNA, 20 bp, mouse
ggggcggggaagctggcgac

SEQ ID NO: 852686 - DNA, 20 bp, mouse
gatgcagggcggggaggcac

SEQ ID NO: 852687 - DNA, 20 bp, mouse
gccggggcgcgaagcggaga

SEQ ID NO: 852688 - DNA, 20 bp, mouse
gaggaagcgagcactgctta

SEQ ID NO: 852689 - DNA, 20 bp, mouse
ggcacaggtaggttagacga

SEQ ID NO: 852690 - DNA, 20 bp, mouse
gagggcggggaggcacaggt

SEQ ID NO: 852691 - DNA, 20 bp, mouse
gcacgcgtgtgcggccgcct

SEQ ID NO: 852692 - DNA, 20 bp, mouse
ggtgtgcggccgcctgggca

SEQ ID NO: 852693 - DNA, 20 bp, mouse
gaggtaggttagacgaaggt

SEQ ID NO: 852694 - DNA, 20 bp, mouse
ggtgtggggacacgcgtgtg

SEQ ID NO: 852695 - DNA, 20 bp, mouse
gctgcgatgggagccgccga

SEQ ID NO: 852696 - DNA, 20 bp, mouse
gctgaccaactgtggtctct

SEQ ID NO: 852697 - DNA, 20 bp, mouse
gaagggtgatccaaggggca

SEQ ID NO: 852698 - DNA, 20 bp, mouse
gtggctagacctactgcatt

SEQ ID NO: 852699 - DNA, 20 bp, mouse
ggagacccagagaccacagt

SEQ ID NO: 852700 - DNA, 20 bp, mouse
ggccagatgctgaccaactg

SEQ ID NO: 852701 - DNA, 20 bp, mouse
gtccttgttgtcttggagtc

SEQ ID NO: 852702 - DNA, 20 bp, mouse
gcctcagccagagatcccaa

SEQ ID NO: 852703 - DNA, 20 bp, mouse
gcctgcttggttccaaacta

SEQ ID NO: 852704 - DNA, 20 bp, mouse
gtgctgttgtatcacagtag

SEQ ID NO: 852705 - DNA, 20 bp, mouse
ggatccaaggggcagggttt

SEQ ID NO: 852706 - DNA, 20 bp, mouse
gcaccccggcggcaccgcga

SEQ ID NO: 852707 - DNA, 20 bp, mouse
gccacctcgcacctgcgccg

SEQ ID NO: 852708 - DNA, 20 bp, mouse
gacctgcgccggggccctcg

SEQ ID NO: 852709 - DNA, 20 bp, mouse
ggcgaccggcggaactctgg

SEQ ID NO: 852710 - DNA, 20 bp, mouse
ggaggaccgcaggcgaccgg

SEQ ID NO: 852711 - DNA, 20 bp, mouse
ggtccgatcccgcaccccgg

SEQ ID NO: 852712 - DNA, 20 bp, mouse
ggggaaggcgggcgactcgt

SEQ ID NO: 852713 - DNA, 20 bp, mouse
gcgtgcgccgcctgcccacg

SEQ ID NO: 852714 - DNA, 20 bp, mouse
gtgggcaggcggcgcacgtg

SEQ ID NO: 852715 - DNA, 20 bp, mouse
gaggtggcccggccggagcg

SEQ ID NO: 852716 - DNA, 20 bp, mouse
gaataccggggcggctgtag

SEQ ID NO: 852717 - DNA, 20 bp, mouse
ggcggctgtagaggagtgta

SEQ ID NO: 852718 - DNA, 20 bp, mouse
ggcagtagccgcccctggtg

SEQ ID NO: 852719 - DNA, 20 bp, mouse
gtgcgcgcgccagacttata

SEQ ID NO: 852720 - DNA, 20 bp, mouse
ggcggctactgcagtacgct

SEQ ID NO: 852721 - DNA, 20 bp, mouse
gaggtctattaataccgggg

SEQ ID NO: 852722 - DNA, 20 bp, mouse
ggcgcgcaacgcaccccctg

SEQ ID NO: 852723 - DNA, 20 bp, mouse
gggctgcaactcaatcctca

SEQ ID NO: 852724 - DNA, 20 bp, mouse
gcagcaagccacaccagggg

SEQ ID NO: 852725 - DNA, 20 bp, mouse
gtagggaggggccacagata

SEQ ID NO: 852726 - DNA, 20 bp, mouse
ggctgggaggagacacctat

SEQ ID NO: 852727 - DNA, 20 bp, mouse
ggggaggagacacctatagg

SEQ ID NO: 852728 - DNA, 20 bp, mouse
gcttcccccgcaggccttga

SEQ ID NO: 852729 - DNA, 20 bp, mouse
gccaaagggccaccacctat

SEQ ID NO: 852730 - DNA, 20 bp, mouse
gaaggcctgcgggggaaggc

SEQ ID NO: 852731 - DNA, 20 bp, mouse
ggggctgaaggtctatccag

SEQ ID NO: 852732 - DNA, 20 bp, mouse
gcaagaaggggcagaagccc

SEQ ID NO: 852733 - DNA, 20 bp, mouse
ggagaggtgtgtgtaaacga

SEQ ID NO: 852734 - DNA, 20 bp, mouse
gccaacaggttcgttcagag

SEQ ID NO: 852735 - DNA, 20 bp, mouse
gaagggcttagtgtccctca

SEQ ID NO: 852736 - DNA, 20 bp, mouse
gggagtgcaggtagcggtgg

SEQ ID NO: 852737 - DNA, 20 bp, mouse
gagaaggtctacatcgttca

SEQ ID NO: 852738 - DNA, 20 bp, mouse
gagtgcaggccatattgcgc

SEQ ID NO: 852739 - DNA, 20 bp, mouse
gtggtcaggacggacgcccg

SEQ ID NO: 852740 - DNA, 20 bp, mouse
gacctcctccctgcgcaata

SEQ ID NO: 852741 - DNA, 20 bp, mouse
ggcggggcggccacgtggtc

SEQ ID NO: 852742 - DNA, 20 bp, mouse
gggcgtccgtcctgaccacg

SEQ ID NO: 852743 - DNA, 20 bp, mouse
ggcaatatggcctgcactcg

SEQ ID NO: 852744 - DNA, 20 bp, mouse
gggcggccacgtggtcagga

SEQ ID NO: 852745 - DNA, 20 bp, mouse
gcatggagtgcaggtagcgg

SEQ ID NO: 852746 - DNA, 20 bp, mouse
ggacggggttgggagaacga

SEQ ID NO: 852747 - DNA, 20 bp, mouse
ggacggtacgaaaacacaat

SEQ ID NO: 852748 - DNA, 20 bp, mouse
ggcgtcatcagtgcccgcga

SEQ ID NO: 852749 - DNA, 20 bp, mouse
gtggacgcgccggaagtctt

SEQ ID NO: 852750 - DNA, 20 bp, mouse
gacgaaaatgggacggggtt

SEQ ID NO: 852751 - DNA, 20 bp, mouse
gaaatcaaggccacgaaaat

SEQ ID NO: 852752 - DNA, 20 bp, mouse
gaatcggctcgcagaaccag

SEQ ID NO: 852753 - DNA, 20 bp, mouse
gcgacggaggcgacttccga

SEQ ID NO: 852754 - DNA, 20 bp, mouse
gctcccgctactttttccgt

SEQ ID NO: 852755 - DNA, 20 bp, mouse
gtgtgttttcgtaccgtcgt

SEQ ID NO: 852756 - DNA, 20 bp, mouse
gcccgcgcccgggagccaat

SEQ ID NO: 852757 - DNA, 20 bp, mouse
gagccaatgggaacgtcgtg

SEQ ID NO: 852758 - DNA, 20 bp, mouse
gtcgtgaggctacagaccgg

SEQ ID NO: 852759 - DNA, 20 bp, mouse
gcgcgggcgacgtctctcgc

SEQ ID NO: 852760 - DNA, 20 bp, mouse
gtgaatggaagagtgaacgg

SEQ ID NO: 852761 - DNA, 20 bp, mouse
ggggacatggcgaactgcgc

SEQ ID NO: 852762 - DNA, 20 bp, mouse
gtgaacgggggcgggctcgg

SEQ ID NO: 852763 - DNA, 20 bp, mouse
gcgcgcctggccgtcgtgtc

SEQ ID NO: 852764 - DNA, 20 bp, mouse
gaggtcgccgcggtcgcccg

SEQ ID NO: 852765 - DNA, 20 bp, mouse
gacgtcgtgaggctacagac

SEQ ID NO: 852766 - DNA, 20 bp, mouse
ggtgatacccgagagcatgt

SEQ ID NO: 852767 - DNA, 20 bp, mouse
ggccgcgcaccgaccggaag

SEQ ID NO: 852768 - DNA, 20 bp, mouse
gcttgcgccgaggacccgag

SEQ ID NO: 852769 - DNA, 20 bp, mouse
gggcgctccagccgtttctc

SEQ ID NO: 852770 - DNA, 20 bp, mouse
ggacccgagcgggaggctca

SEQ ID NO: 852771 - DNA, 20 bp, mouse
ggcaggcgcgggctttccga

SEQ ID NO: 852772 - DNA, 20 bp, mouse
gtaaagaaaaagttcacttt

SEQ ID NO: 852773 - DNA, 20 bp, mouse
gagcctcccgctcgggtcct

SEQ ID NO: 852774 - DNA, 20 bp, mouse
gccgccgtgagcctcccgct

SEQ ID NO: 852775 - DNA, 20 bp, mouse
gcgcctgcaacttagagttt

SEQ ID NO: 852776 - DNA, 20 bp, mouse
gggccctcgcggcgccccgt

SEQ ID NO: 852777 - DNA, 20 bp, mouse
gggagaggcagcagcatcta

SEQ ID NO: 852778 - DNA, 20 bp, mouse
gtgcctacggggcgccgcga

SEQ ID NO: 852779 - DNA, 20 bp, mouse
gcgggcttccaagaactcgg

SEQ ID NO: 852780 - DNA, 20 bp, mouse
gaacggagatcccccgggaa

SEQ ID NO: 852781 - DNA, 20 bp, mouse
ggacccaggagtcccatctc

SEQ ID NO: 852782 - DNA, 20 bp, mouse
gctacggcaagactactaaa

SEQ ID NO: 852783 - DNA, 20 bp, mouse
gcgttcgagagcactcgata

SEQ ID NO: 852784 - DNA, 20 bp, mouse
gtcccccgggaagggtggcc

SEQ ID NO: 852785 - DNA, 20 bp, mouse
gagaactcggcggttcttgg

SEQ ID NO: 852786 - DNA, 20 bp, mouse
gccgccgggtccaccttaag

SEQ ID NO: 852787 - DNA, 20 bp, mouse
gcaagagagctcccgggtta

SEQ ID NO: 852788 - DNA, 20 bp, mouse
gtgcgcgtgcgtggggtgtc

SEQ ID NO: 852789 - DNA, 20 bp, mouse
gtaccccgcaaaagaggagt

SEQ ID NO: 852790 - DNA, 20 bp, mouse
gccgccgccgcccgtggggt

SEQ ID NO: 852791 - DNA, 20 bp, mouse
gctaactcttagtgtgtgga

SEQ ID NO: 852792 - DNA, 20 bp, mouse
gagcgcccatctggaccgac

SEQ ID NO: 852793 - DNA, 20 bp, mouse
ggagggctgagaactggcta

SEQ ID NO: 852794 - DNA, 20 bp, mouse
gctaccgcaggccctaaccc

SEQ ID NO: 852795 - DNA, 20 bp, mouse
gtaggcccaagagagctccc

SEQ ID NO: 852796 - DNA, 20 bp, mouse
ggactcccacgcaatctcga

SEQ ID NO: 852797 - DNA, 20 bp, mouse
gcaaaagcggaggcgtaagg

SEQ ID NO: 852798 - DNA, 20 bp, mouse
gtgggcttgtagcaaggaga

SEQ ID NO: 852799 - DNA, 20 bp, mouse
gtggctggagcttggcaggt

SEQ ID NO: 852800 - DNA, 20 bp, mouse
gccccaacgcgtactaccat

SEQ ID NO: 852801 - DNA, 20 bp, mouse
gcttctgaatgggacttagg

SEQ ID NO: 852802 - DNA, 20 bp, mouse
gggtgtggaccggacaaggg

SEQ ID NO: 852803 - DNA, 20 bp, mouse
gtccagccagcttctctctg

SEQ ID NO: 852804 - DNA, 20 bp, mouse
gggaattcagggttagagtc

SEQ ID NO: 852805 - DNA, 20 bp, mouse
gggagaggcccagggtaaga

SEQ ID NO: 852806 - DNA, 20 bp, mouse
ggggctctggggacaggaat

SEQ ID NO: 852807 - DNA, 20 bp, mouse
gaaaccaggtgcggtgggga

SEQ ID NO: 852808 - DNA, 20 bp, mouse
gtcaaactctgcagcgtcca

SEQ ID NO: 852809 - DNA, 20 bp, mouse
gggccggaaccttgttgcta

SEQ ID NO: 852810 - DNA, 20 bp, mouse
gaggctgccgcaaaccaccc

SEQ ID NO: 852811 - DNA, 20 bp, mouse
gctagggccggggtggtttg

SEQ ID NO: 852812 - DNA, 20 bp, mouse
ggagaatagtgctggggctc

SEQ ID NO: 852813 - DNA, 20 bp, mouse
gcctagcggcgctcgctcta

SEQ ID NO: 852814 - DNA, 20 bp, mouse
ggtagcggagaatagtgctg

SEQ ID NO: 852815 - DNA, 20 bp, mouse
ggcggcgctcgctctacggc

SEQ ID NO: 852816 - DNA, 20 bp, mouse
ggctccgtggggctcctgcg

SEQ ID NO: 852817 - DNA, 20 bp, mouse
gggtacctgcgtgtggtgat

SEQ ID NO: 852818 - DNA, 20 bp, mouse
gtcgcacccagtggctccgt

SEQ ID NO: 852819 - DNA, 20 bp, mouse
gggaataaatgcgcccctga

SEQ ID NO: 852820 - DNA, 20 bp, mouse
gccagggttgccacttaaac

SEQ ID NO: 852821 - DNA, 20 bp, mouse
gggagccccacggagccact

SEQ ID NO: 852822 - DNA, 20 bp, mouse
gtggcgtttggcatcccgga

SEQ ID NO: 852823 - DNA, 20 bp, mouse
gaacacatcgatgccatcag

SEQ ID NO: 852824 - DNA, 20 bp, mouse
gcacacgcaggtacccgggc

SEQ ID NO: 852825 - DNA, 20 bp, mouse
ggccgcccatcaccacacgc

SEQ ID NO: 852826 - DNA, 20 bp, mouse
gccacctatctttgtgggga

SEQ ID NO: 852827 - DNA, 20 bp, mouse
gccaaaggcttgcttgacgg

SEQ ID NO: 852828 - DNA, 20 bp, mouse
gataggtggcgcgtgtttca

SEQ ID NO: 852829 - DNA, 20 bp, mouse
gtatccctccccacaaagat

SEQ ID NO: 852830 - DNA, 20 bp, mouse
gccaaggggcgaaagttaaa

SEQ ID NO: 852831 - DNA, 20 bp, mouse
gtcacatgatgctcacgctc

SEQ ID NO: 852832 - DNA, 20 bp, mouse
gcagagtactgggcggaaaa

SEQ ID NO: 852833 - DNA, 20 bp, mouse
gacgcgccacctatctttgt

SEQ ID NO: 852834 - DNA, 20 bp, mouse
gcagaactggagaactccaa

SEQ ID NO: 852835 - DNA, 20 bp, mouse
gaacacgtcagtccgtcccc

SEQ ID NO: 852836 - DNA, 20 bp, mouse
ggaagctaacgtggagactg

SEQ ID NO: 852837 - DNA, 20 bp, mouse
gcggaggcggctgaaggttc

SEQ ID NO: 852838 - DNA, 20 bp, mouse
gtagcgaggggctaactcgc

SEQ ID NO: 852839 - DNA, 20 bp, mouse
gaactcgcaggagcaggttc

SEQ ID NO: 852840 - DNA, 20 bp, mouse
ggacagtagggcactattgg

SEQ ID NO: 852841 - DNA, 20 bp, mouse
ggagactggggcctcagctt

SEQ ID NO: 852842 - DNA, 20 bp, mouse
gaagacgtcgggttgggcac

SEQ ID NO: 852843 - DNA, 20 bp, mouse
ggtcccgccgcgaacgtggg

SEQ ID NO: 852844 - DNA, 20 bp, mouse
gggaaccctggaagctaacg

SEQ ID NO: 852845 - DNA, 20 bp, mouse
gccccccgatcctgttccga

SEQ ID NO: 852846 - DNA, 20 bp, mouse
gatggggcgaggcgagcatg

SEQ ID NO: 852847 - DNA, 20 bp, mouse
gaagcgcgcaagtgtcttca

SEQ ID NO: 852848 - DNA, 20 bp, mouse
ggggactccgcgatggggcg

SEQ ID NO: 852849 - DNA, 20 bp, mouse
gtggggcgggactccgcgat

SEQ ID NO: 852850 - DNA, 20 bp, mouse
gcaaggccccgcctctcctg

SEQ ID NO: 852851 - DNA, 20 bp, mouse
ggagtcccgccccaccccac

SEQ ID NO: 852852 - DNA, 20 bp, mouse
gcgggacccccggtggggtg

SEQ ID NO: 852853 - DNA, 20 bp, mouse
gtgctcgcctcgccccatcg

SEQ ID NO: 852854 - DNA, 20 bp, mouse
gggcaaggcggggctttcgg

SEQ ID NO: 852855 - DNA, 20 bp, mouse
gcgggggcgggacccccggt

SEQ ID NO: 852856 - DNA, 20 bp, mouse
gagacggagaaatggcacta

SEQ ID NO: 852857 - DNA, 20 bp, mouse
gtaaggacacggagagcgag

SEQ ID NO: 852858 - DNA, 20 bp, mouse
gcacaaaagccagcaataga

SEQ ID NO: 852859 - DNA, 20 bp, mouse
gaaaccacaagacggagaaa

SEQ ID NO: 852860 - DNA, 20 bp, mouse
gcctggggtgttacaaagta

SEQ ID NO: 852861 - DNA, 20 bp, mouse
ggtgccatttctccgtcttg

SEQ ID NO: 852862 - DNA, 20 bp, mouse
gggttgctgccttctattgc

SEQ ID NO: 852863 - DNA, 20 bp, mouse
gctgcaaattcaaagcccct

SEQ ID NO: 852864 - DNA, 20 bp, mouse
gtaaactgggcgcagtgcag

SEQ ID NO: 852865 - DNA, 20 bp, mouse
gactctctggtttgtatcag

SEQ ID NO: 852866 - DNA, 20 bp, mouse
ggggatagggagggacgaaa

SEQ ID NO: 852867 - DNA, 20 bp, mouse
gtccggccgggtcctgtctc

SEQ ID NO: 852868 - DNA, 20 bp, mouse
ggcgcccaaaatgtcatcga

SEQ ID NO: 852869 - DNA, 20 bp, mouse
ggaaaaggccgtagaactgc

SEQ ID NO: 852870 - DNA, 20 bp, mouse
gggtcataacacgaaggaat

SEQ ID NO: 852871 - DNA, 20 bp, mouse
ggggccgactctagatgtta

SEQ ID NO: 852872 - DNA, 20 bp, mouse
gtcgtgttatgacccccaga

SEQ ID NO: 852873 - DNA, 20 bp, mouse
gtggccttcgatgacatttt

SEQ ID NO: 852874 - DNA, 20 bp, mouse
gactctggatctgtcggctg

SEQ ID NO: 852875 - DNA, 20 bp, mouse
gactctagatgttaggggat

SEQ ID NO: 852876 - DNA, 20 bp, mouse
gtggacgtgtcggtggacaa

SEQ ID NO: 852877 - DNA, 20 bp, mouse
gaaggcaaagatggacgtgt

SEQ ID NO: 852878 - DNA, 20 bp, mouse
gccgggcaacagtagattgc

SEQ ID NO: 852879 - DNA, 20 bp, mouse
gacgtgtcggtggacaaggg

SEQ ID NO: 852880 - DNA, 20 bp, mouse
ggcaaagatggacgtgtcgg

SEQ ID NO: 852881 - DNA, 20 bp, mouse
gaaaagaggtagcctcggtc

SEQ ID NO: 852882 - DNA, 20 bp, mouse
ggtaaactgggatggagggg

SEQ ID NO: 852883 - DNA, 20 bp, mouse
ggacgaagtgagcaggctaa

SEQ ID NO: 852884 - DNA, 20 bp, mouse
gcgctctgacgtcatcacgt

SEQ ID NO: 852885 - DNA, 20 bp, mouse
ggggcgtggctcaactcttc

SEQ ID NO: 852886 - DNA, 20 bp, mouse
gcaaggccgccagatctccc

SEQ ID NO: 852887 - DNA, 20 bp, mouse
gcgtgcgagccggggagatc

SEQ ID NO: 852888 - DNA, 20 bp, mouse
ggggcccggggcgtcacagc

SEQ ID NO: 852889 - DNA, 20 bp, mouse
gcgggacagcgccgtggctg

SEQ ID NO: 852890 - DNA, 20 bp, mouse
gcccgccagcgccgccgcac

SEQ ID NO: 852891 - DNA, 20 bp, mouse
gcggccggctgtgacgcccc

SEQ ID NO: 852892 - DNA, 20 bp, mouse
ggcgagccggggagatctgg

SEQ ID NO: 852893 - DNA, 20 bp, mouse
gacggcgctgtcccgtgcgg

SEQ ID NO: 852894 - DNA, 20 bp, mouse
ggctgcgactccactgccgg

SEQ ID NO: 852895 - DNA, 20 bp, mouse
ggccacggcgctgtcccgtg

SEQ ID NO: 852896 - DNA, 20 bp, mouse
gccctcgcgagctgattgga

SEQ ID NO: 852897 - DNA, 20 bp, mouse
ggtcgcacgggctttcagga

SEQ ID NO: 852898 - DNA, 20 bp, mouse
gagtggctggggcacttcta

SEQ ID NO: 852899 - DNA, 20 bp, mouse
gtccgagcaaccgccagccg

SEQ ID NO: 852900 - DNA, 20 bp, mouse
ggagacggggcacagcgtct

SEQ ID NO: 852901 - DNA, 20 bp, mouse
gctagggcagggtaggagac

SEQ ID NO: 852902 - DNA, 20 bp, mouse
gtggttgcaggacccgtcta

SEQ ID NO: 852903 - DNA, 20 bp, mouse
gggcggggcctagtcttccg

SEQ ID NO: 852904 - DNA, 20 bp, mouse
gaatcagctcgcgaggggcg

SEQ ID NO: 852905 - DNA, 20 bp, mouse
gtcggacgccggggtcgcac

SEQ ID NO: 852906 - DNA, 20 bp, mouse
ggggacgaagcgtgagaaac

SEQ ID NO: 852907 - DNA, 20 bp, mouse
gtggctgagggcggacaata

SEQ ID NO: 852908 - DNA, 20 bp, mouse
gccggagggtgactgggcga

SEQ ID NO: 852909 - DNA, 20 bp, mouse
gggaaggcacggcccggagg

SEQ ID NO: 852910 - DNA, 20 bp, mouse
gctcgccccgcccccaagtg

SEQ ID NO: 852911 - DNA, 20 bp, mouse
gcggcccgcggggccctggg

SEQ ID NO: 852912 - DNA, 20 bp, mouse
gtgctgcggcgggtccacgg

SEQ ID NO: 852913 - DNA, 20 bp, mouse
gccgcgggccggagggtgac

SEQ ID NO: 852914 - DNA, 20 bp, mouse
gggggcggggccgcacttgg

SEQ ID NO: 852915 - DNA, 20 bp, mouse
gcgcggcgcgatgacgtcgc

SEQ ID NO: 852916 - DNA, 20 bp, mouse
gaaagcaaattgcttatgat

SEQ ID NO: 852917 - DNA, 20 bp, mouse
ggggaggagatttgactctc

SEQ ID NO: 852918 - DNA, 20 bp, mouse
gccacctcccgcaattctag

SEQ ID NO: 852919 - DNA, 20 bp, mouse
gtggccactagaattgcggg

SEQ ID NO: 852920 - DNA, 20 bp, mouse
gaatctcctccctgttagtg

SEQ ID NO: 852921 - DNA, 20 bp, mouse
gaagaaaccagcttatccag

SEQ ID NO: 852922 - DNA, 20 bp, mouse
gactaaacccctggataagc

SEQ ID NO: 852923 - DNA, 20 bp, mouse
gggagcttggtattcaggtt

SEQ ID NO: 852924 - DNA, 20 bp, mouse
gttaacctaacctgctagcg

SEQ ID NO: 852925 - DNA, 20 bp, mouse
gagctctcagcctcactaac

SEQ ID NO: 852926 - DNA, 20 bp, mouse
gtgggggcggggccggatct

SEQ ID NO: 852927 - DNA, 20 bp, mouse
gctaacctagcccgctgacc

SEQ ID NO: 852928 - DNA, 20 bp, mouse
gtcaagggagcgcccgcgat

SEQ ID NO: 852929 - DNA, 20 bp, mouse
gcccgctgcctaattatgac

SEQ ID NO: 852930 - DNA, 20 bp, mouse
gcgcgggccggaggcggcgt

SEQ ID NO: 852931 - DNA, 20 bp, mouse
ggccggtcataattaggcag

SEQ ID NO: 852932 - DNA, 20 bp, mouse
gggctctggtgcagacttgg

SEQ ID NO: 852933 - DNA, 20 bp, mouse
gcccgcccccacgccgcctc

SEQ ID NO: 852934 - DNA, 20 bp, mouse
gtctcggagagtgctattat

SEQ ID NO: 852935 - DNA, 20 bp, mouse
gcagacttgggggacggcga

SEQ ID NO: 852936 - DNA, 20 bp, mouse
ggatcacagcgtcccgcccc

SEQ ID NO: 852937 - DNA, 20 bp, mouse
ggacgagaggccggcaccta

SEQ ID NO: 852938 - DNA, 20 bp, mouse
gcgcagaacgccgggacgag

SEQ ID NO: 852939 - DNA, 20 bp, mouse
ggggacggctgcgagtgggc

SEQ ID NO: 852940 - DNA, 20 bp, mouse
gggcgggacgctgtgatcct

SEQ ID NO: 852941 - DNA, 20 bp, mouse
gtcaacccgaccggcaactt

SEQ ID NO: 852942 - DNA, 20 bp, mouse
gaagaggattcaggacattc

SEQ ID NO: 852943 - DNA, 20 bp, mouse
gtacacctagtcaacccgac

SEQ ID NO: 852944 - DNA, 20 bp, mouse
gatcctcttccgtgcgggga

SEQ ID NO: 852945 - DNA, 20 bp, mouse
gacgctgtgatcctgggacg

SEQ ID NO: 852946 - DNA, 20 bp, mouse
gtaagactgcagggacacaa

SEQ ID NO: 852947 - DNA, 20 bp, mouse
gccagcaccgcggcggacat

SEQ ID NO: 852948 - DNA, 20 bp, mouse
gcccgcctgccacctcggac

SEQ ID NO: 852949 - DNA, 20 bp, mouse
gagaaagcctctgtagaagg

SEQ ID NO: 852950 - DNA, 20 bp, mouse
gaggggacagttaagactgc

SEQ ID NO: 852951 - DNA, 20 bp, mouse
gccgcggcggacatgggggt

SEQ ID NO: 852952 - DNA, 20 bp, mouse
gctgtctcgcaagactcgga

SEQ ID NO: 852953 - DNA, 20 bp, mouse
gacctcggacgggatgctag

SEQ ID NO: 852954 - DNA, 20 bp, mouse
ggaggggcgtgcacagtacc

SEQ ID NO: 852955 - DNA, 20 bp, mouse
ggtccgccgcggtgctggct

SEQ ID NO: 852956 - DNA, 20 bp, mouse
gtccgctagctgtctataga

SEQ ID NO: 852957 - DNA, 20 bp, mouse
gctgccccgccctgagatct

SEQ ID NO: 852958 - DNA, 20 bp, mouse
gacccaggtccctgcgtcct

SEQ ID NO: 852959 - DNA, 20 bp, mouse
ggcagaccgtccatatccac

SEQ ID NO: 852960 - DNA, 20 bp, mouse
gtcccaggacgcagggacct

SEQ ID NO: 852961 - DNA, 20 bp, mouse
ggggggccaagatctcaggg

SEQ ID NO: 852962 - DNA, 20 bp, mouse
ggctagctgtctatagaggg

SEQ ID NO: 852963 - DNA, 20 bp, mouse
gcggagtcaaccggtgtccc

SEQ ID NO: 852964 - DNA, 20 bp, mouse
gcggggcagccccactgagc

SEQ ID NO: 852965 - DNA, 20 bp, mouse
gaaccggtgtcccaggacgc

SEQ ID NO: 852966 - DNA, 20 bp, mouse
gcgcaccgcccgaggaaggg

SEQ ID NO: 852967 - DNA, 20 bp, mouse
gcgcgcgcctgcggggacct

SEQ ID NO: 852968 - DNA, 20 bp, mouse
ggcgcgcaccgcccgaggaa

SEQ ID NO: 852969 - DNA, 20 bp, mouse
gtacacagcaacaaagcgga

SEQ ID NO: 852970 - DNA, 20 bp, mouse
ggtgtaatgtggatccccga

SEQ ID NO: 852971 - DNA, 20 bp, mouse
gcccgccccccttcctcggg

SEQ ID NO: 852972 - DNA, 20 bp, mouse
gttgcagcgcgcaccgcccg

SEQ ID NO: 852973 - DNA, 20 bp, mouse
gcagcgcgactgtagatgtc

SEQ ID NO: 852974 - DNA, 20 bp, mouse
gcaggccgggctgctcgcgg

SEQ ID NO: 852975 - DNA, 20 bp, mouse
gtatgtccccaggtccccgc

SEQ ID NO: 852976 - DNA, 20 bp, mouse
ggggagaggtgtaattagtg

SEQ ID NO: 852977 - DNA, 20 bp, mouse
ggacgaggcgactaaggaga

SEQ ID NO: 852978 - DNA, 20 bp, mouse
gaggagccctggaagtcgcg

SEQ ID NO: 852979 - DNA, 20 bp, mouse
ggccctggacgaggcgacta

SEQ ID NO: 852980 - DNA, 20 bp, mouse
ggggagcctcgcgacttcca

SEQ ID NO: 852981 - DNA, 20 bp, mouse
gcgactaaggagacggagga

SEQ ID NO: 852982 - DNA, 20 bp, mouse
gcggaggatggggacctccg

SEQ ID NO: 852983 - DNA, 20 bp, mouse
ggaggcgactaaggagacgg

SEQ ID NO: 852984 - DNA, 20 bp, mouse
gtccttagtcgcctcgtcca

SEQ ID NO: 852985 - DNA, 20 bp, mouse
ggcgcgtcatttgcagtctg

SEQ ID NO: 852986 - DNA, 20 bp, mouse
gcctacacctgcagcggtct

SEQ ID NO: 852987 - DNA, 20 bp, mouse
ggctggcgatcgcccccttc

SEQ ID NO: 852988 - DNA, 20 bp, mouse
gtgtcccccgacagcgtctc

SEQ ID NO: 852989 - DNA, 20 bp, mouse
gagggggcgatcgccagcta

SEQ ID NO: 852990 - DNA, 20 bp, mouse
gtctccagagacgctgtcgg

SEQ ID NO: 852991 - DNA, 20 bp, mouse
gaaggccgccctctgccaga

SEQ ID NO: 852992 - DNA, 20 bp, mouse
gagggaatagtaatcagaga

SEQ ID NO: 852993 - DNA, 20 bp, mouse
gaggcgcagtgagcggacga

SEQ ID NO: 852994 - DNA, 20 bp, mouse
gatcgcccccttctggcaga

SEQ ID NO: 852995 - DNA, 20 bp, mouse
gcgttctccagagacgctgt

SEQ ID NO: 852996 - DNA, 20 bp, mouse
gcggccgttcccagagtcct

SEQ ID NO: 852997 - DNA, 20 bp, mouse
gaaggtgtgtgcttccagtg

SEQ ID NO: 852998 - DNA, 20 bp, mouse
gagctgtgacgctgaggtgt

SEQ ID NO: 852999 - DNA, 20 bp, mouse
gaacgtacgcattattagtt

SEQ ID NO: 853000 - DNA, 20 bp, mouse
gcgcggctcagaggcattat

SEQ ID NO: 853001 - DNA, 20 bp, mouse
gcctcggagctgtgacgctg

SEQ ID NO: 853002 - DNA, 20 bp, mouse
gtctgggtgggtgtaacacg

SEQ ID NO: 853003 - DNA, 20 bp, mouse
gagcagagatccctgggagt

SEQ ID NO: 853004 - DNA, 20 bp, mouse
gacgcattattagttgggta

SEQ ID NO: 853005 - DNA, 20 bp, mouse
gcccagagttcctagcagcg

SEQ ID NO: 853006 - DNA, 20 bp, mouse
gggaacgtctgggttaagat

SEQ ID NO: 853007 - DNA, 20 bp, mouse
gtactccaaacggaacgtct

SEQ ID NO: 853008 - DNA, 20 bp, mouse
gttaacccagacgttccgtt

SEQ ID NO: 853009 - DNA, 20 bp, mouse
gctgctactcacgaataaga

SEQ ID NO: 853010 - DNA, 20 bp, mouse
gtttgcgtcaagtatgggag

SEQ ID NO: 853011 - DNA, 20 bp, mouse
gctactcacgaataagaagg

SEQ ID NO: 853012 - DNA, 20 bp, mouse
gcgtgcactaaaatcccaga

SEQ ID NO: 853013 - DNA, 20 bp, mouse
gaagtaacagcggctctgat

SEQ ID NO: 853014 - DNA, 20 bp, mouse
ggctttgtcgtgtactcagt

SEQ ID NO: 853015 - DNA, 20 bp, mouse
gcccatacttgacgcaaatg

SEQ ID NO: 853016 - DNA, 20 bp, mouse
ggtacagaaaggttgatgga

SEQ ID NO: 853017 - DNA, 20 bp, mouse
gctaaagccctgcccgccct

SEQ ID NO: 853018 - DNA, 20 bp, mouse
gcaggcaggccggcctctct

SEQ ID NO: 853019 - DNA, 20 bp, mouse
gacacctcggtgcccagggc

SEQ ID NO: 853020 - DNA, 20 bp, mouse
gggcctctctaggaatcgac

SEQ ID NO: 853021 - DNA, 20 bp, mouse
ggctttagcccgccaggcag

SEQ ID NO: 853022 - DNA, 20 bp, mouse
gttgtcgagatgaaggatag

SEQ ID NO: 853023 - DNA, 20 bp, mouse
gggagagtgccgctgcctgg

SEQ ID NO: 853024 - DNA, 20 bp, mouse
gcccccgtcgattcctagag

SEQ ID NO: 853025 - DNA, 20 bp, mouse
ggcaaatattgtcgagatga

SEQ ID NO: 853026 - DNA, 20 bp, mouse
gtgccacagcttatggtgga

SEQ ID NO: 853027 - DNA, 20 bp, mouse
gcaagtggccttactcaaaa

SEQ ID NO: 853028 - DNA, 20 bp, mouse
ggtggagggcttagaaagta

SEQ ID NO: 853029 - DNA, 20 bp, mouse
gaaaagaaggtgcagccaat

SEQ ID NO: 853030 - DNA, 20 bp, mouse
ggaacataagaagtgaacaa

SEQ ID NO: 853031 - DNA, 20 bp, mouse
gacactgccacagcttatgg

SEQ ID NO: 853032 - DNA, 20 bp, mouse
gaaggatgaagagcccagat

SEQ ID NO: 853033 - DNA, 20 bp, mouse
gagccctccaccataagctg

SEQ ID NO: 853034 - DNA, 20 bp, mouse
gccagaaagagcttggaaaa

SEQ ID NO: 853035 - DNA, 20 bp, mouse
gttgagtaaggccacttgtc

SEQ ID NO: 853036 - DNA, 20 bp, mouse
gttaactagagtgaggtcgg

SEQ ID NO: 853037 - DNA, 20 bp, mouse
gtgcctcggcggaagttcat

SEQ ID NO: 853038 - DNA, 20 bp, mouse
gcgcttagaaaggaagttgt

SEQ ID NO: 853039 - DNA, 20 bp, mouse
gtcggtggaaattgcttttt

SEQ ID NO: 853040 - DNA, 20 bp, mouse
gtagctggtagtcactataa

SEQ ID NO: 853041 - DNA, 20 bp, mouse
gccagagggcataactatcc

SEQ ID NO: 853042 - DNA, 20 bp, mouse
ggcttggaaccttctcgttc

SEQ ID NO: 853043 - DNA, 20 bp, mouse
gtcggtctggagctttttct

SEQ ID NO: 853044 - DNA, 20 bp, mouse
gaaagggtaggtctctgtct

SEQ ID NO: 853045 - DNA, 20 bp, mouse
gctaaaccatgggacttagc

SEQ ID NO: 853046 - DNA, 20 bp, mouse
ggtccccggggccagttcga

SEQ ID NO: 853047 - DNA, 20 bp, mouse
gaaaggttacacccatttga

SEQ ID NO: 853048 - DNA, 20 bp, mouse
gccggcgcctgtgtaggtcg

SEQ ID NO: 853049 - DNA, 20 bp, mouse
gaatgggtgtaacctttcta

SEQ ID NO: 853050 - DNA, 20 bp, mouse
gataagaagtacttactaat

SEQ ID NO: 853051 - DNA, 20 bp, mouse
ggttacacccatttgaggga

SEQ ID NO: 853052 - DNA, 20 bp, mouse
gccagccgtcgaactggccc

SEQ ID NO: 853053 - DNA, 20 bp, mouse
gttctaaggaaggtttctga

SEQ ID NO: 853054 - DNA, 20 bp, mouse
ggtagttccggcgcctgtgt

SEQ ID NO: 853055 - DNA, 20 bp, mouse
gcagaaatattgtggggatt

SEQ ID NO: 853056 - DNA, 20 bp, mouse
gcggaggtgcaaataggaaa

SEQ ID NO: 853057 - DNA, 20 bp, mouse
gcctgggagtccaagtggtg

SEQ ID NO: 853058 - DNA, 20 bp, mouse
gtccaagtggtgagggcaac

SEQ ID NO: 853059 - DNA, 20 bp, mouse
ggctaggaataatcctccct

SEQ ID NO: 853060 - DNA, 20 bp, mouse
gagtggtgagggcaacaggc

SEQ ID NO: 853061 - DNA, 20 bp, mouse
gggtgacccggagagtgttt

SEQ ID NO: 853062 - DNA, 20 bp, mouse
gctggcaagagctggaccgg

SEQ ID NO: 853063 - DNA, 20 bp, mouse
gccggggtatctgggttccc

SEQ ID NO: 853064 - DNA, 20 bp, mouse
ggaacccagataccccggaa

SEQ ID NO: 853065 - DNA, 20 bp, mouse
gaccccggaacggaagcctg

SEQ ID NO: 853066 - DNA, 20 bp, mouse
gggaagctaggcatgggcaa

SEQ ID NO: 853067 - DNA, 20 bp, mouse
gcctctgtggacagagaccg

SEQ ID NO: 853068 - DNA, 20 bp, mouse
gagcaaggaaggcgggacga

SEQ ID NO: 853069 - DNA, 20 bp, mouse
gtctctgtccacagaggtac

SEQ ID NO: 853070 - DNA, 20 bp, mouse
gacgtcgagcggcagcagtt

SEQ ID NO: 853071 - DNA, 20 bp, mouse
gaggggacagatggaaccta

SEQ ID NO: 853072 - DNA, 20 bp, mouse
ggtagcagagcaaggaaggc

SEQ ID NO: 853073 - DNA, 20 bp, mouse
gggggagggaatccggattg

SEQ ID NO: 853074 - DNA, 20 bp, mouse
gggccggaagtgctggtgtt

SEQ ID NO: 853075 - DNA, 20 bp, mouse
gtaggcatgggcaagggggt

SEQ ID NO: 853076 - DNA, 20 bp, mouse
gaaatcccgaaaagcaactc

SEQ ID NO: 853077 - DNA, 20 bp, mouse
gcattcccagaatgcctcag

SEQ ID NO: 853078 - DNA, 20 bp, mouse
gacacagagaatctctacct

SEQ ID NO: 853079 - DNA, 20 bp, mouse
gtaacagctgttaggtagtt

SEQ ID NO: 853080 - DNA, 20 bp, mouse
gagctgttaaaacagctagg

SEQ ID NO: 853081 - DNA, 20 bp, mouse
gtccttggatatagcttttt

SEQ ID NO: 853082 - DNA, 20 bp, mouse
gttcccagaatgctaaagtt

SEQ ID NO: 853083 - DNA, 20 bp, mouse
gtccaaaaaagctatatcca

SEQ ID NO: 853084 - DNA, 20 bp, mouse
ggagctaggtgcttccactg

SEQ ID NO: 853085 - DNA, 20 bp, mouse
gctagctctggtgctctttt

SEQ ID NO: 853086 - DNA, 20 bp, mouse
gtatcatcccggggatggga

SEQ ID NO: 853087 - DNA, 20 bp, mouse
gagaggccatccttccggtt

SEQ ID NO: 853088 - DNA, 20 bp, mouse
ggcggaagtgccatggagta

SEQ ID NO: 853089 - DNA, 20 bp, mouse
ggaagttatcttatcatccc

SEQ ID NO: 853090 - DNA, 20 bp, mouse
gagcacgtcagggactgctt

SEQ ID NO: 853091 - DNA, 20 bp, mouse
gatcctctgcaggagactgc

SEQ ID NO: 853092 - DNA, 20 bp, mouse
gcagtccctgacgtgctctg

SEQ ID NO: 853093 - DNA, 20 bp, mouse
ggaagtgactcttcccgcat

SEQ ID NO: 853094 - DNA, 20 bp, mouse
gtcatgaccctcccatcccc

SEQ ID NO: 853095 - DNA, 20 bp, mouse
gtccccgagcggaagtgcca

SEQ ID NO: 853096 - DNA, 20 bp, mouse
gttgctggccaggttgggaa

SEQ ID NO: 853097 - DNA, 20 bp, mouse
gggaggtcttcatctctcga

SEQ ID NO: 853098 - DNA, 20 bp, mouse
gctgatggtgctgttctcga

SEQ ID NO: 853099 - DNA, 20 bp, mouse
gtctctcgatggtacgctga

SEQ ID NO: 853100 - DNA, 20 bp, mouse
gacccggaaacgatatgggg

SEQ ID NO: 853101 - DNA, 20 bp, mouse
ggtgctgttctcgatggtgc

SEQ ID NO: 853102 - DNA, 20 bp, mouse
ggacgacccggaaacgatat

SEQ ID NO: 853103 - DNA, 20 bp, mouse
gcgatggtgctgggaaacaa

SEQ ID NO: 853104 - DNA, 20 bp, mouse
gttgctctctctaggaaaat

SEQ ID NO: 853105 - DNA, 20 bp, mouse
gagtgggcatttgttgtcct

SEQ ID NO: 853106 - DNA, 20 bp, mouse
gtggggaatgtcattacaga

SEQ ID NO: 853107 - DNA, 20 bp, mouse
gaaaaaaaaaagatttccgg

SEQ ID NO: 853108 - DNA, 20 bp, mouse
gaagggggagcttgctctcc

SEQ ID NO: 853109 - DNA, 20 bp, mouse
gacagaagggcactatagtt

SEQ ID NO: 853110 - DNA, 20 bp, mouse
gttctgaaatgccactgtca

SEQ ID NO: 853111 - DNA, 20 bp, mouse
gtgggcttacaatcacactt

SEQ ID NO: 853112 - DNA, 20 bp, mouse
gacaaacaacggcaaacaac

SEQ ID NO: 853113 - DNA, 20 bp, mouse
gataaatcgaaaagcaaccc

SEQ ID NO: 853114 - DNA, 20 bp, mouse
ggagtctgaccgcctggagt

SEQ ID NO: 853115 - DNA, 20 bp, mouse
gtggaatgagggatccccgc

SEQ ID NO: 853116 - DNA, 20 bp, mouse
gagagaagtgggcatatgac

SEQ ID NO: 853117 - DNA, 20 bp, mouse
gagagaaaggagcgcacacc

SEQ ID NO: 853118 - DNA, 20 bp, mouse
gatgacaggcagagagagaa

SEQ ID NO: 853119 - DNA, 20 bp, mouse
gcggccgtgattggctagta

SEQ ID NO: 853120 - DNA, 20 bp, mouse
gcacagccctcggtgactag

SEQ ID NO: 853121 - DNA, 20 bp, mouse
gacagctcccctagtcaccg

SEQ ID NO: 853122 - DNA, 20 bp, mouse
gcacagaactgtctcagacg

SEQ ID NO: 853123 - DNA, 20 bp, mouse
gctgtgcctgagcggacacc

SEQ ID NO: 853124 - DNA, 20 bp, mouse
ggggagagagctccggtggc

SEQ ID NO: 853125 - DNA, 20 bp, mouse
gggatccatgcggccgtgat

SEQ ID NO: 853126 - DNA, 20 bp, mouse
gtggtggcatcagcaaatga

SEQ ID NO: 853127 - DNA, 20 bp, mouse
gagagctccggtggcttagg

SEQ ID NO: 853128 - DNA, 20 bp, mouse
gagagaaagaagcgcacacg

SEQ ID NO: 853129 - DNA, 20 bp, mouse
ggaaacagaccgggcgcgcc

SEQ ID NO: 853130 - DNA, 20 bp, mouse
gtggtgtaaaaaaactttat

SEQ ID NO: 853131 - DNA, 20 bp, mouse
gatgtatccacctaagccac

SEQ ID NO: 853132 - DNA, 20 bp, mouse
ggagagagctccggtggctt

SEQ ID NO: 853133 - DNA, 20 bp, mouse
gatgcatggcgtaatttctc

SEQ ID NO: 853134 - DNA, 20 bp, mouse
gaatttctcaggacacactt

SEQ ID NO: 853135 - DNA, 20 bp, mouse
gaaaactttattgggggtgg

SEQ ID NO: 853136 - DNA, 20 bp, mouse
gggggccgcccagaactctt

SEQ ID NO: 853137 - DNA, 20 bp, mouse
ggaagcctaagagttctggg

SEQ ID NO: 853138 - DNA, 20 bp, mouse
gcagaactcttaggcttcca

SEQ ID NO: 853139 - DNA, 20 bp, mouse
gcccacaagctgctgaaacg

SEQ ID NO: 853140 - DNA, 20 bp, mouse
ggcccctccccaaagatgaa

SEQ ID NO: 853141 - DNA, 20 bp, mouse
gaccacagggaccagcccag

SEQ ID NO: 853142 - DNA, 20 bp, mouse
gacaagctgctgaaacgagg

SEQ ID NO: 853143 - DNA, 20 bp, mouse
gagacttgtgcgacgatccc

SEQ ID NO: 853144 - DNA, 20 bp, mouse
gaccaagctgggagaggtct

SEQ ID NO: 853145 - DNA, 20 bp, mouse
ggcgcagcatgcgtgccact

SEQ ID NO: 853146 - DNA, 20 bp, mouse
gcaacacactctaatcctat

SEQ ID NO: 853147 - DNA, 20 bp, mouse
gcagaggccagtccttttcc

SEQ ID NO: 853148 - DNA, 20 bp, mouse
gtaactcagcaacagcaaat

SEQ ID NO: 853149 - DNA, 20 bp, mouse
gcacactctaatcctatggg

SEQ ID NO: 853150 - DNA, 20 bp, mouse
gtgccactcaaaagtgaagg

SEQ ID NO: 853151 - DNA, 20 bp, mouse
gcacttttgagtggcagatc

SEQ ID NO: 853152 - DNA, 20 bp, mouse
ggccaatcaggacatccagc

SEQ ID NO: 853153 - DNA, 20 bp, mouse
gtttgagtggcagatccggc

SEQ ID NO: 853154 - DNA, 20 bp, mouse
gatttctacagacccggaaa

SEQ ID NO: 853155 - DNA, 20 bp, mouse
gatgcaaatttctacagacc

SEQ ID NO: 853156 - DNA, 20 bp, mouse
gacaaaacaacccataatga

SEQ ID NO: 853157 - DNA, 20 bp, mouse
gaaagatggaccagatcatc

SEQ ID NO: 853158 - DNA, 20 bp, mouse
ggtgataaaaccagatgatc

SEQ ID NO: 853159 - DNA, 20 bp, mouse
gataaatatcccatgtaaaa

SEQ ID NO: 853160 - DNA, 20 bp, mouse
gtggtgttctccctcattat

SEQ ID NO: 853161 - DNA, 20 bp, mouse
gatctgtgatggttattaca

SEQ ID NO: 853162 - DNA, 20 bp, mouse
gatgaataaagtttacaaat

SEQ ID NO: 853163 - DNA, 20 bp, mouse
gggtatgtaagtaatcatag

SEQ ID NO: 853164 - DNA, 20 bp, mouse
gaagtttacaaattggtcta

SEQ ID NO: 853165 - DNA, 20 bp, mouse
gcttgatgaaatgattgaac

SEQ ID NO: 853166 - DNA, 20 bp, mouse
gccgctgcgcgcccaactca

SEQ ID NO: 853167 - DNA, 20 bp, mouse
gagggagtgcaaccactcac

SEQ ID NO: 853168 - DNA, 20 bp, mouse
gtgcccgcacccgcaggtaa

SEQ ID NO: 853169 - DNA, 20 bp, mouse
gggcctggcctctggtctaa

SEQ ID NO: 853170 - DNA, 20 bp, mouse
ggcgggtgcgggcatcactt

SEQ ID NO: 853171 - DNA, 20 bp, mouse
gaatgtaagctgacctctgc

SEQ ID NO: 853172 - DNA, 20 bp, mouse
gtgccctgaactcagccgtc

SEQ ID NO: 853173 - DNA, 20 bp, mouse
gtccccgattggtcaacgtt

SEQ ID NO: 853174 - DNA, 20 bp, mouse
gggcgggaggattattttcc

SEQ ID NO: 853175 - DNA, 20 bp, mouse
gtgaccaatcggggaaggcc

SEQ ID NO: 853176 - DNA, 20 bp, mouse
gtgggagaaagtgtcagtgc

SEQ ID NO: 853177 - DNA, 20 bp, mouse
gctacagctgagttggggaa

SEQ ID NO: 853178 - DNA, 20 bp, mouse
ggaccggaaccctcaaatct

SEQ ID NO: 853179 - DNA, 20 bp, mouse
gagcagaggcaagggacccc

SEQ ID NO: 853180 - DNA, 20 bp, mouse
gggaactcgccctgtagccg

SEQ ID NO: 853181 - DNA, 20 bp, mouse
gcaacgcttactatacccaa

SEQ ID NO: 853182 - DNA, 20 bp, mouse
gctgcacctgcttttggctt

SEQ ID NO: 853183 - DNA, 20 bp, mouse
gtgtaaagctacagctgagt

SEQ ID NO: 853184 - DNA, 20 bp, mouse
gtacagagttcccagatttg

SEQ ID NO: 853185 - DNA, 20 bp, mouse
gagggtccaaagtgctccag

SEQ ID NO: 853186 - DNA, 20 bp, mouse
gtccccgcgcggcgcttcga

SEQ ID NO: 853187 - DNA, 20 bp, mouse
gcccctggggcccagtaagg

SEQ ID NO: 853188 - DNA, 20 bp, mouse
ggcgcttcgaaggcttccgt

SEQ ID NO: 853189 - DNA, 20 bp, mouse
gacgcccctggggcccagta

SEQ ID NO: 853190 - DNA, 20 bp, mouse
gcccccccgggggggattcg

SEQ ID NO: 853191 - DNA, 20 bp, mouse
gagccccgaatcccccccgg

SEQ ID NO: 853192 - DNA, 20 bp, mouse
ggggagccccgaatcccccc

SEQ ID NO: 853193 - DNA, 20 bp, mouse
gggcagtctgagcaccggga

SEQ ID NO: 853194 - DNA, 20 bp, mouse
ggcagctacgggcccggtgg

SEQ ID NO: 853195 - DNA, 20 bp, mouse
gcgaactcccggtggaatac

SEQ ID NO: 853196 - DNA, 20 bp, mouse
gtgctcggggctgtgatggg

SEQ ID NO: 853197 - DNA, 20 bp, mouse
gagcgtgctcggggctgtga

SEQ ID NO: 853198 - DNA, 20 bp, mouse
ggcccagtgagctaggtttg

SEQ ID NO: 853199 - DNA, 20 bp, mouse
ggagtgcgcaagcgtgctcg

SEQ ID NO: 853200 - DNA, 20 bp, mouse
gggtccaagatcacacccag

SEQ ID NO: 853201 - DNA, 20 bp, mouse
gaggtttggggtggggattt

SEQ ID NO: 853202 - DNA, 20 bp, mouse
ggatcttggaccagctggaa

SEQ ID NO: 853203 - DNA, 20 bp, mouse
ggggaaatgtagtccatggt

SEQ ID NO: 853204 - DNA, 20 bp, mouse
gttgtgtcgttgccctacca

SEQ ID NO: 853205 - DNA, 20 bp, mouse
ggagggtgtaggcatgatca

SEQ ID NO: 853206 - DNA, 20 bp, mouse
gtgcgcgccgtccccgaagt

SEQ ID NO: 853207 - DNA, 20 bp, mouse
gtggagcgtgagtgcagcca

SEQ ID NO: 853208 - DNA, 20 bp, mouse
gagaaatgataggaacccct

SEQ ID NO: 853209 - DNA, 20 bp, mouse
gtctgacctccacagccagt

SEQ ID NO: 853210 - DNA, 20 bp, mouse
gcgtgcatacctactggctg

SEQ ID NO: 853211 - DNA, 20 bp, mouse
ggcatacctactggctgtgg

SEQ ID NO: 853212 - DNA, 20 bp, mouse
gtgataggaacccctgggat

SEQ ID NO: 853213 - DNA, 20 bp, mouse
gaggaactgaggcactttga

SEQ ID NO: 853214 - DNA, 20 bp, mouse
ggccccccgtgcatacctac

SEQ ID NO: 853215 - DNA, 20 bp, mouse
gccagtcttgcctggttata

SEQ ID NO: 853216 - DNA, 20 bp, mouse
gcaaggcccgtgctactcta

SEQ ID NO: 853217 - DNA, 20 bp, mouse
ggggtactcaaggacataga

SEQ ID NO: 853218 - DNA, 20 bp, mouse
ggaagtagatgcagcagtcc

SEQ ID NO: 853219 - DNA, 20 bp, mouse
ggtggcaaggactccgtggt

SEQ ID NO: 853220 - DNA, 20 bp, mouse
gaagagtggcaaggactccg

SEQ ID NO: 853221 - DNA, 20 bp, mouse
gcctctaggaatctgacgtg

SEQ ID NO: 853222 - DNA, 20 bp, mouse
gagcgccgctagtcccgccc

SEQ ID NO: 853223 - DNA, 20 bp, mouse
ggagccactccagtcccagt

SEQ ID NO: 853224 - DNA, 20 bp, mouse
gggaaccatcgagaattgca

SEQ ID NO: 853225 - DNA, 20 bp, mouse
gctctggccctcacactcga

SEQ ID NO: 853226 - DNA, 20 bp, mouse
gggtcaggcaacaatgacgc

SEQ ID NO: 853227 - DNA, 20 bp, mouse
gctacccgctcatgagtggc

SEQ ID NO: 853228 - DNA, 20 bp, mouse
gcactcatgagcgggtagga

SEQ ID NO: 853229 - DNA, 20 bp, mouse
ggaagactcttgctctcgat

SEQ ID NO: 853230 - DNA, 20 bp, mouse
ggtgaggtgggcgtagttag

SEQ ID NO: 853231 - DNA, 20 bp, mouse
gaggtgggcgtagttagtgg

SEQ ID NO: 853232 - DNA, 20 bp, mouse
gcccgctggggccccagaat

SEQ ID NO: 853233 - DNA, 20 bp, mouse
gacagcccaatggagggtag

SEQ ID NO: 853234 - DNA, 20 bp, mouse
ggcgccagccactcatgagc

SEQ ID NO: 853235 - DNA, 20 bp, mouse
ggggactcagaattgctatg

SEQ ID NO: 853236 - DNA, 20 bp, mouse
gcctgagtgcgcagacgcag

SEQ ID NO: 853237 - DNA, 20 bp, mouse
gaagtctccgcgacatctca

SEQ ID NO: 853238 - DNA, 20 bp, mouse
gggtctggggagtactgaac

SEQ ID NO: 853239 - DNA, 20 bp, mouse
gaggcggccaggtttgtgcg

SEQ ID NO: 853240 - DNA, 20 bp, mouse
gcgtctcccacgcacaaacc

SEQ ID NO: 853241 - DNA, 20 bp, mouse
gcgcccgtgaagtaccaaag

SEQ ID NO: 853242 - DNA, 20 bp, mouse
gacccaaggtaaatggtctg

SEQ ID NO: 853243 - DNA, 20 bp, mouse
gacttcccacaaggcactgc

SEQ ID NO: 853244 - DNA, 20 bp, mouse
gaacaagccctgagatgtcg

SEQ ID NO: 853245 - DNA, 20 bp, mouse
gagaaaccccaaatcacaag

SEQ ID NO: 853246 - DNA, 20 bp, mouse
ggggcgggaacgtcgatgaa

SEQ ID NO: 853247 - DNA, 20 bp, mouse
gctcgcttggcgcggagacc

SEQ ID NO: 853248 - DNA, 20 bp, mouse
gctggctgcgagaccaagcg

SEQ ID NO: 853249 - DNA, 20 bp, mouse
gtctcgactgctctgggagg

SEQ ID NO: 853250 - DNA, 20 bp, mouse
gcgggccgccggccctcgct

SEQ ID NO: 853251 - DNA, 20 bp, mouse
gggcacgcacccagcctcaa

SEQ ID NO: 853252 - DNA, 20 bp, mouse
gtgccggcgcggtgcattat

SEQ ID NO: 853253 - DNA, 20 bp, mouse
gcggcgtggccgggaaagct

SEQ ID NO: 853254 - DNA, 20 bp, mouse
gagctgggaaagccactgag

SEQ ID NO: 853255 - DNA, 20 bp, mouse
gcgcgccaagcgagggccgg

SEQ ID NO: 853256 - DNA, 20 bp, mouse
gaggaaggaggttctgtcac

SEQ ID NO: 853257 - DNA, 20 bp, mouse
gtcacgcttcaacccagggg

SEQ ID NO: 853258 - DNA, 20 bp, mouse
gacagttcacgcttcaaccc

SEQ ID NO: 853259 - DNA, 20 bp, mouse
gaagcgtgaactgtcactca

SEQ ID NO: 853260 - DNA, 20 bp, mouse
ggacaaggccttgctttcat

SEQ ID NO: 853261 - DNA, 20 bp, mouse
gtctggcttcatccacccct

SEQ ID NO: 853262 - DNA, 20 bp, mouse
gcagtctattgtgtctgata

SEQ ID NO: 853263 - DNA, 20 bp, mouse
gacccaatcagacacacggt

SEQ ID NO: 853264 - DNA, 20 bp, mouse
ggatgaagccagaattgaca

SEQ ID NO: 853265 - DNA, 20 bp, mouse
gagacacacggtcggaaggg

SEQ ID NO: 853266 - DNA, 20 bp, mouse
gaggacctgaatgctgagaa

SEQ ID NO: 853267 - DNA, 20 bp, mouse
ggctgagaatggcgtggtga

SEQ ID NO: 853268 - DNA, 20 bp, mouse
ggattgacgctaacaagggg

SEQ ID NO: 853269 - DNA, 20 bp, mouse
gctggccactgcgtgctagt

SEQ ID NO: 853270 - DNA, 20 bp, mouse
ggctctgagaaggaaatttt

SEQ ID NO: 853271 - DNA, 20 bp, mouse
gtgagggcttagaactgttt

SEQ ID NO: 853272 - DNA, 20 bp, mouse
gtcagatccggggtaaaata

SEQ ID NO: 853273 - DNA, 20 bp, mouse
gatccggggtaaaataaggc

SEQ ID NO: 853274 - DNA, 20 bp, mouse
gaacctgtgggagaataagg

SEQ ID NO: 853275 - DNA, 20 bp, mouse
gactgcgtgctagtgggact

SEQ ID NO: 853276 - DNA, 20 bp, mouse
gaaagagtccggcagtgcta

SEQ ID NO: 853277 - DNA, 20 bp, mouse
gcccacgcagcgctagagat

SEQ ID NO: 853278 - DNA, 20 bp, mouse
gtggggtgtcctgcagtacg

SEQ ID NO: 853279 - DNA, 20 bp, mouse
gttgcagccaagtcagcatg

SEQ ID NO: 853280 - DNA, 20 bp, mouse
ggaagcttcagactatagga

SEQ ID NO: 853281 - DNA, 20 bp, mouse
gacccgaagcttcagactat

SEQ ID NO: 853282 - DNA, 20 bp, mouse
gtgcggaagtacaccgaccg

SEQ ID NO: 853283 - DNA, 20 bp, mouse
gtagaatcgtccacaggcac

SEQ ID NO: 853284 - DNA, 20 bp, mouse
ggcgcgcgcgtcaccccggt

SEQ ID NO: 853285 - DNA, 20 bp, mouse
gaggcacaggtgacgactgc

SEQ ID NO: 853286 - DNA, 20 bp, mouse
gtggggcagcagaaagtgcg

SEQ ID NO: 853287 - DNA, 20 bp, mouse
gggctccaagagctacccac

SEQ ID NO: 853288 - DNA, 20 bp, mouse
gaggcccgcctctcctctac

SEQ ID NO: 853289 - DNA, 20 bp, mouse
gtgacctgaagccccccata

SEQ ID NO: 853290 - DNA, 20 bp, mouse
gcctgaagccccccatacgg

SEQ ID NO: 853291 - DNA, 20 bp, mouse
ggtacttgaaacaggaccca

SEQ ID NO: 853292 - DNA, 20 bp, mouse
ggtccagcgagtcctccgta

SEQ ID NO: 853293 - DNA, 20 bp, mouse
ggcctctcctctacaggact

SEQ ID NO: 853294 - DNA, 20 bp, mouse
gcggttggctgagggaattt

SEQ ID NO: 853295 - DNA, 20 bp, mouse
gcttgggagtcgtagttcag

SEQ ID NO: 853296 - DNA, 20 bp, mouse
ggaggcctcgaactcgagtg

SEQ ID NO: 853297 - DNA, 20 bp, mouse
gaactcagcgccaaggggcg

SEQ ID NO: 853298 - DNA, 20 bp, mouse
gtgtgtgaaggcgtcttcta

SEQ ID NO: 853299 - DNA, 20 bp, mouse
gtacaagaggactttcccat

SEQ ID NO: 853300 - DNA, 20 bp, mouse
ggccaccaccctgaaaggac

SEQ ID NO: 853301 - DNA, 20 bp, mouse
gcattggccaccaccctgaa

SEQ ID NO: 853302 - DNA, 20 bp, mouse
gcatcccagtcctttcaggg

SEQ ID NO: 853303 - DNA, 20 bp, mouse
gtggcgctgagttctgacag

SEQ ID NO: 853304 - DNA, 20 bp, mouse
ggtccatcccagtcctttca

SEQ ID NO: 853305 - DNA, 20 bp, mouse
ggcagcctcactcgagttcg

SEQ ID NO: 853306 - DNA, 20 bp, mouse
gcgcaggcgcagagggtagt

SEQ ID NO: 853307 - DNA, 20 bp, mouse
gaggctcaacgcaggcgcag

SEQ ID NO: 853308 - DNA, 20 bp, mouse
gaggcgaccaggctcaacgc

SEQ ID NO: 853309 - DNA, 20 bp, mouse
gatggcgcgcaaaggcgacc

SEQ ID NO: 853310 - DNA, 20 bp, mouse
gagagggtagtgggccgcgt

SEQ ID NO: 853311 - DNA, 20 bp, mouse
gtgcgcgccatgttgactat

SEQ ID NO: 853312 - DNA, 20 bp, mouse
ggggagtataaaagaaacag

SEQ ID NO: 853313 - DNA, 20 bp, mouse
gtcgcctaaacttaggacag

SEQ ID NO: 853314 - DNA, 20 bp, mouse
ggtcggtgatgtcaccgatt

SEQ ID NO: 853315 - DNA, 20 bp, mouse
gttggcggatgctgtctcaa

SEQ ID NO: 853316 - DNA, 20 bp, mouse
gacacacaggagcgcctcac

SEQ ID NO: 853317 - DNA, 20 bp, mouse
gcatctggatccaggatcct

SEQ ID NO: 853318 - DNA, 20 bp, mouse
gacctcccgagccaccagga

SEQ ID NO: 853319 - DNA, 20 bp, mouse
gctcctgtgtgttgcgggga

SEQ ID NO: 853320 - DNA, 20 bp, mouse
gcacacaccctcagggtttt

SEQ ID NO: 853321 - DNA, 20 bp, mouse
ggggaggtcagatccttagg

SEQ ID NO: 853322 - DNA, 20 bp, mouse
gtctccgcccaaaaccctga

SEQ ID NO: 853323 - DNA, 20 bp, mouse
gtccctcctggtggctcggg

SEQ ID NO: 853324 - DNA, 20 bp, mouse
gtgtgggcgtggaaaggggt

SEQ ID NO: 853325 - DNA, 20 bp, mouse
ggaggcgctcctgtgtgttg

SEQ ID NO: 853326 - DNA, 20 bp, mouse
gacaccggctggagaatgtg

SEQ ID NO: 853327 - DNA, 20 bp, mouse
gggaaggggtgggaggaccg

SEQ ID NO: 853328 - DNA, 20 bp, mouse
gagcgcgcggggcaacgaag

SEQ ID NO: 853329 - DNA, 20 bp, mouse
gcattgggcggagcagggaa

SEQ ID NO: 853330 - DNA, 20 bp, mouse
ggtggtgcgcgggctccctc

SEQ ID NO: 853331 - DNA, 20 bp, mouse
gcaacgaagaggcacggact

SEQ ID NO: 853332 - DNA, 20 bp, mouse
gagaatgtgcggaatgtgcc

SEQ ID NO: 853333 - DNA, 20 bp, mouse
gaagggccctcgctgactag

SEQ ID NO: 853334 - DNA, 20 bp, mouse
ggtgggaggaccgaggacac

SEQ ID NO: 853335 - DNA, 20 bp, mouse
gtactcaataatcccctcac

SEQ ID NO: 853336 - DNA, 20 bp, mouse
gtaggtctgggcaacgtcag

SEQ ID NO: 853337 - DNA, 20 bp, mouse
gtcccggaatgcataggtct

SEQ ID NO: 853338 - DNA, 20 bp, mouse
ggcaagcgaactacatttcc

SEQ ID NO: 853339 - DNA, 20 bp, mouse
gagatgagagcttacttcag

SEQ ID NO: 853340 - DNA, 20 bp, mouse
ggggcacgtctggcgctctt

SEQ ID NO: 853341 - DNA, 20 bp, mouse
gtggctgagtcgggcacgtc

SEQ ID NO: 853342 - DNA, 20 bp, mouse
gtgcccagacctatgcattc

SEQ ID NO: 853343 - DNA, 20 bp, mouse
gcggaggggacgagttcaga

SEQ ID NO: 853344 - DNA, 20 bp, mouse
gaggcggtggctcgctccct

SEQ ID NO: 853345 - DNA, 20 bp, mouse
gggcggcgctgatcgtgtct

SEQ ID NO: 853346 - DNA, 20 bp, mouse
ggcggcctgctgcacttcgg

SEQ ID NO: 853347 - DNA, 20 bp, mouse
gagtgcccggtactcctctc

SEQ ID NO: 853348 - DNA, 20 bp, mouse
gaggtgcggcttgatgacaa

SEQ ID NO: 853349 - DNA, 20 bp, mouse
ggatgcccggggttgccatg

SEQ ID NO: 853350 - DNA, 20 bp, mouse
gtaaccagagggctccggag

SEQ ID NO: 853351 - DNA, 20 bp, mouse
ggggctccggagaggagtac

SEQ ID NO: 853352 - DNA, 20 bp, mouse
gcgggacgacgaggctgcgg

SEQ ID NO: 853353 - DNA, 20 bp, mouse
ggatgacaatggccgcattg

SEQ ID NO: 853354 - DNA, 20 bp, mouse
gaggccccgccacactggac

SEQ ID NO: 853355 - DNA, 20 bp, mouse
gaggaggagggcgcgggtag

SEQ ID NO: 853356 - DNA, 20 bp, mouse
gcaactggaagccctgtcga

SEQ ID NO: 853357 - DNA, 20 bp, mouse
gcacccccttgcatgaggtt

SEQ ID NO: 853358 - DNA, 20 bp, mouse
gtcatgcaagggggtgtcca

SEQ ID NO: 853359 - DNA, 20 bp, mouse
ggcactaggggagcaatcgc

SEQ ID NO: 853360 - DNA, 20 bp, mouse
ggattgctcccctagtgctc

SEQ ID NO: 853361 - DNA, 20 bp, mouse
gctcccctagtgctcaggca

SEQ ID NO: 853362 - DNA, 20 bp, mouse
gtcatcctaacctcatgcaa

SEQ ID NO: 853363 - DNA, 20 bp, mouse
gtccaaggttctcttaattt

SEQ ID NO: 853364 - DNA, 20 bp, mouse
gacagggcttccagttgcgc

SEQ ID NO: 853365 - DNA, 20 bp, mouse
gaaagaagggcacatgaatg

SEQ ID NO: 853366 - DNA, 20 bp, mouse
gcatagagggcagcagtcca

SEQ ID NO: 853367 - DNA, 20 bp, mouse
gcatgccgggaagcattccc

SEQ ID NO: 853368 - DNA, 20 bp, mouse
gaccactcgccccacctcca

SEQ ID NO: 853369 - DNA, 20 bp, mouse
gccacgcctaggaaggtgat

SEQ ID NO: 853370 - DNA, 20 bp, mouse
gaaaggggactggccataga

SEQ ID NO: 853371 - DNA, 20 bp, mouse
gtctccagtgagacccatgc

SEQ ID NO: 853372 - DNA, 20 bp, mouse
ggcaaacccatcaccttcct

SEQ ID NO: 853373 - DNA, 20 bp, mouse
gcagtccagggaatgcttcc

SEQ ID NO: 853374 - DNA, 20 bp, mouse
gaaaactgcgtgggaaggag

SEQ ID NO: 853375 - DNA, 20 bp, mouse
gggtcctctgcgcccggaac

SEQ ID NO: 853376 - DNA, 20 bp, mouse
ggcgctgccgccatcttaat

SEQ ID NO: 853377 - DNA, 20 bp, mouse
gatcccgtatgcaaattgaa

SEQ ID NO: 853378 - DNA, 20 bp, mouse
gccgtatgcaaattgaaggg

SEQ ID NO: 853379 - DNA, 20 bp, mouse
gaagtggtggtggcgctccc

SEQ ID NO: 853380 - DNA, 20 bp, mouse
gtggatgacccaagctctaa

SEQ ID NO: 853381 - DNA, 20 bp, mouse
gtcttaatggggttaagtgg

SEQ ID NO: 853382 - DNA, 20 bp, mouse
gggaggtggagatagaacga

SEQ ID NO: 853383 - DNA, 20 bp, mouse
gtgtgcgggtcacgtgacgc

SEQ ID NO: 853384 - DNA, 20 bp, mouse
gggtcacgtgacgcaggctt

SEQ ID NO: 853385 - DNA, 20 bp, mouse
gcgcaggcttcggccctgag

SEQ ID NO: 853386 - DNA, 20 bp, mouse
gagtgtggggtgtaagcgta

SEQ ID NO: 853387 - DNA, 20 bp, mouse
gccgctgccgctcttcttgg

SEQ ID NO: 853388 - DNA, 20 bp, mouse
gtggggactagtagaaaagg

SEQ ID NO: 853389 - DNA, 20 bp, mouse
gccgccgccgtgttgataca

SEQ ID NO: 853390 - DNA, 20 bp, mouse
ggcgtagggaggagagcgtg

SEQ ID NO: 853391 - DNA, 20 bp, mouse
ggcgtggggactagtagaaa

SEQ ID NO: 853392 - DNA, 20 bp, mouse
gagtagaaaaggaggctaat

SEQ ID NO: 853393 - DNA, 20 bp, mouse
gaacagaaataccgcgcggt

SEQ ID NO: 853394 - DNA, 20 bp, mouse
gaaattcagtcattgagtgt

SEQ ID NO: 853395 - DNA, 20 bp, mouse
ggagccgctgccgctcttct

SEQ ID NO: 853396 - DNA, 20 bp, mouse
gcctcccaagcatccgactt

SEQ ID NO: 853397 - DNA, 20 bp, mouse
ggggcagccaatgaacaggg

SEQ ID NO: 853398 - DNA, 20 bp, mouse
ggatgggcagccaatgaaca

SEQ ID NO: 853399 - DNA, 20 bp, mouse
gtagctccagggtgtcagat

SEQ ID NO: 853400 - DNA, 20 bp, mouse
ggggcaggaagctcgcgcgg

SEQ ID NO: 853401 - DNA, 20 bp, mouse
ggagaatcctccctgttcat

SEQ ID NO: 853402 - DNA, 20 bp, mouse
ggctctgggcggtgtgtcct

SEQ ID NO: 853403 - DNA, 20 bp, mouse
gtatccagaatgtcggagat

SEQ ID NO: 853404 - DNA, 20 bp, mouse
ggaagcgccgagctcccgcg

SEQ ID NO: 853405 - DNA, 20 bp, mouse
gcctgccccgggcgctgctg

SEQ ID NO: 853406 - DNA, 20 bp, mouse
gcgcgtgcgcgggagcccac

SEQ ID NO: 853407 - DNA, 20 bp, mouse
gcacacgcgcggtcacagag

SEQ ID NO: 853408 - DNA, 20 bp, mouse
gaggcgcgagccccgcggag

SEQ ID NO: 853409 - DNA, 20 bp, mouse
gcgcgcctcggggggtccga

SEQ ID NO: 853410 - DNA, 20 bp, mouse
gcccgggcggttccagtgac

SEQ ID NO: 853411 - DNA, 20 bp, mouse
gcgagcgcgccacgttaggc

SEQ ID NO: 853412 - DNA, 20 bp, mouse
gccgacccgcccaccgctgc

SEQ ID NO: 853413 - DNA, 20 bp, mouse
ggggcgtggcccgcagcggt

SEQ ID NO: 853414 - DNA, 20 bp, mouse
ggcccccctcggaccccccg

SEQ ID NO: 853415 - DNA, 20 bp, mouse
gccgcggggctcgcgcctcg

SEQ ID NO: 853416 - DNA, 20 bp, mouse
gcaaactgcagggatagtga

SEQ ID NO: 853417 - DNA, 20 bp, mouse
gagtgggtggagacagatct

SEQ ID NO: 853418 - DNA, 20 bp, mouse
gctgggatcaggctctggaa

SEQ ID NO: 853419 - DNA, 20 bp, mouse
gcagatctgggatcaggctc

SEQ ID NO: 853420 - DNA, 20 bp, mouse
gaatggagagaacgcaatcc

SEQ ID NO: 853421 - DNA, 20 bp, mouse
gactatccctgcagtttgat

SEQ ID NO: 853422 - DNA, 20 bp, mouse
gcttcccccaatcaaactgc

SEQ ID NO: 853423 - DNA, 20 bp, mouse
ggttacgtgtgagtattagt

SEQ ID NO: 853424 - DNA, 20 bp, mouse
gtcacacgtaactttgtcat

SEQ ID NO: 853425 - DNA, 20 bp, mouse
gacgtgtgagtattagtggg

SEQ ID NO: 853426 - DNA, 20 bp, mouse
gcgcgcagaccgttcctcga

SEQ ID NO: 853427 - DNA, 20 bp, mouse
ggacccggacataccaggga

SEQ ID NO: 853428 - DNA, 20 bp, mouse
gcctagacccggacatacca

SEQ ID NO: 853429 - DNA, 20 bp, mouse
ggactggaggagattgtgaa

SEQ ID NO: 853430 - DNA, 20 bp, mouse
gcccgagcctgtgcatgttg

SEQ ID NO: 853431 - DNA, 20 bp, mouse
ggaccgttcctcgaggggac

SEQ ID NO: 853432 - DNA, 20 bp, mouse
ggacataccagggaaggagt

SEQ ID NO: 853433 - DNA, 20 bp, mouse
ggggcgtcgcgcgaggagga

SEQ ID NO: 853434 - DNA, 20 bp, mouse
gctccagtcccctcgaggaa

SEQ ID NO: 853435 - DNA, 20 bp, mouse
ggggcccggggcgtcgcgcg

SEQ ID NO: 853436 - DNA, 20 bp, mouse
ggggcagtgttctctaagga

SEQ ID NO: 853437 - DNA, 20 bp, mouse
gtctgccgcccagtgggcgt

SEQ ID NO: 853438 - DNA, 20 bp, mouse
gtctaaggacggcaaattag

SEQ ID NO: 853439 - DNA, 20 bp, mouse
gaagggggcagtgttctcta

SEQ ID NO: 853440 - DNA, 20 bp, mouse
gccatgggaaagggtgaaaa

SEQ ID NO: 853441 - DNA, 20 bp, mouse
ggtatccaacgcccactggg

SEQ ID NO: 853442 - DNA, 20 bp, mouse
gagttctagagactgttcaa

SEQ ID NO: 853443 - DNA, 20 bp, mouse
gtgagaggacacttaatagt

SEQ ID NO: 853444 - DNA, 20 bp, mouse
ggaagtaggtgggcgggatt

SEQ ID NO: 853445 - DNA, 20 bp, mouse
gcaacatagctgggaccctt

SEQ ID NO: 853446 - DNA, 20 bp, mouse
gcccgggagcgagagacaaa

SEQ ID NO: 853447 - DNA, 20 bp, mouse
gccagcgccagtgacggctg

SEQ ID NO: 853448 - DNA, 20 bp, mouse
gtgttccaagctcttttaac

SEQ ID NO: 853449 - DNA, 20 bp, mouse
gtggaggctttagtagtctg

SEQ ID NO: 853450 - DNA, 20 bp, mouse
gtcccaaaaagcgatttcta

SEQ ID NO: 853451 - DNA, 20 bp, mouse
gaatagaatcctccagtcac

SEQ ID NO: 853452 - DNA, 20 bp, mouse
gacgcagagaaactgcctcg

SEQ ID NO: 853453 - DNA, 20 bp, mouse
gcactcccacagcctgtgac

SEQ ID NO: 853454 - DNA, 20 bp, mouse
gttgggagctcgctcaccgg

SEQ ID NO: 853455 - DNA, 20 bp, mouse
ggggagtgatggtagagcac

SEQ ID NO: 853456 - DNA, 20 bp, mouse
gccgaccggcgttcaaggtc

SEQ ID NO: 853457 - DNA, 20 bp, mouse
gcatcccggaccttgaacgc

SEQ ID NO: 853458 - DNA, 20 bp, mouse
gaggagacggaaggggtcgg

SEQ ID NO: 853459 - DNA, 20 bp, mouse
gcggaccgcgcgggcctcgg

SEQ ID NO: 853460 - DNA, 20 bp, mouse
gggtttgcactgtgcttcgg

SEQ ID NO: 853461 - DNA, 20 bp, mouse
gggcgagccgccggcatagc

SEQ ID NO: 853462 - DNA, 20 bp, mouse
gccgtctcctgagtagttgg

SEQ ID NO: 853463 - DNA, 20 bp, mouse
gtgcgcggcccgacaggcgg

SEQ ID NO: 853464 - DNA, 20 bp, mouse
gcagtcccgaccggcgttca

SEQ ID NO: 853465 - DNA, 20 bp, mouse
gacagtgcaaaccaggccag

SEQ ID NO: 853466 - DNA, 20 bp, mouse
gaacagaatggggctaggaa

SEQ ID NO: 853467 - DNA, 20 bp, mouse
gagagtgagcccatcgtcgc

SEQ ID NO: 853468 - DNA, 20 bp, mouse
gcagaaactagtaacagaat

SEQ ID NO: 853469 - DNA, 20 bp, mouse
ggaagggcttacacacacag

SEQ ID NO: 853470 - DNA, 20 bp, mouse
ggaaatacctaagaccctct

SEQ ID NO: 853471 - DNA, 20 bp, mouse
gagaacaaagttcagtactc

SEQ ID NO: 853472 - DNA, 20 bp, mouse
ggttctgcccagagggtctt

SEQ ID NO: 853473 - DNA, 20 bp, mouse
gctacttccgagctcacttc

SEQ ID NO: 853474 - DNA, 20 bp, mouse
gccaaccacaacctcaaact

SEQ ID NO: 853475 - DNA, 20 bp, mouse
gtgtagcccacatggtcccc

SEQ ID NO: 853476 - DNA, 20 bp, mouse
ggagccttagacagcatcaa

SEQ ID NO: 853477 - DNA, 20 bp, mouse
gctgggaaatgagtctgaca

SEQ ID NO: 853478 - DNA, 20 bp, mouse
gtgcgcatgcgcagaggaag

SEQ ID NO: 853479 - DNA, 20 bp, mouse
gttacaatacagagtgagac

SEQ ID NO: 853480 - DNA, 20 bp, mouse
ggggtctccacgtccagtgt

SEQ ID NO: 853481 - DNA, 20 bp, mouse
gtaccagaaagtcccatcct

SEQ ID NO: 853482 - DNA, 20 bp, mouse
ggcacggtgcactgcaggag

SEQ ID NO: 853483 - DNA, 20 bp, mouse
gcggtgcactgcaggagcgg

SEQ ID NO: 853484 - DNA, 20 bp, mouse
ggctgtatggggaaacgccg

SEQ ID NO: 853485 - DNA, 20 bp, mouse
gcccaacggtgctcgtagtg

SEQ ID NO: 853486 - DNA, 20 bp, mouse
gttagctggttgaaccagag

SEQ ID NO: 853487 - DNA, 20 bp, mouse
ggggctcagagatgctcgcc

SEQ ID NO: 853488 - DNA, 20 bp, mouse
gagaacggcgcccctacgca

SEQ ID NO: 853489 - DNA, 20 bp, mouse
gcccctacgcacggactggg

SEQ ID NO: 853490 - DNA, 20 bp, mouse
ggcgcccctacgcacggact

SEQ ID NO: 853491 - DNA, 20 bp, mouse
gcacttccggagcttcttta

SEQ ID NO: 853492 - DNA, 20 bp, mouse
gccccgcccagtccgtgcgt

SEQ ID NO: 853493 - DNA, 20 bp, mouse
gaaccagctaagatctgtac

SEQ ID NO: 853494 - DNA, 20 bp, mouse
ggatgctgccagtcactggc

SEQ ID NO: 853495 - DNA, 20 bp, mouse
ggaggagacctgccagtgac

SEQ ID NO: 853496 - DNA, 20 bp, mouse
gctaggaaacgcagggtctg

SEQ ID NO: 853497 - DNA, 20 bp, mouse
gtaagaaggggcgggaacag

SEQ ID NO: 853498 - DNA, 20 bp, mouse
gaggggagaagctagataac

SEQ ID NO: 853499 - DNA, 20 bp, mouse
gaactagagaagacccacac

SEQ ID NO: 853500 - DNA, 20 bp, mouse
gcgtcagaccccattatgaa

SEQ ID NO: 853501 - DNA, 20 bp, mouse
gtctgcggcctctttaagaa

SEQ ID NO: 853502 - DNA, 20 bp, mouse
gggaggaagtgaggtcgcag

SEQ ID NO: 853503 - DNA, 20 bp, mouse
gtggagtcctggggacaaac

SEQ ID NO: 853504 - DNA, 20 bp, mouse
gtaaaatgccccggttgctt

SEQ ID NO: 853505 - DNA, 20 bp, mouse
gagtctctgacaaagacttc

SEQ ID NO: 853506 - DNA, 20 bp, mouse
ggggccgcacgaagccacac

SEQ ID NO: 853507 - DNA, 20 bp, mouse
gggaagtacggggtctcagg

SEQ ID NO: 853508 - DNA, 20 bp, mouse
gcgagaacggccttctcgat

SEQ ID NO: 853509 - DNA, 20 bp, mouse
gaggactcggacacggtaaa

SEQ ID NO: 853510 - DNA, 20 bp, mouse
gaagtacaggaaccaagagg

SEQ ID NO: 853511 - DNA, 20 bp, mouse
gtgggattggccaatcgaga

SEQ ID NO: 853512 - DNA, 20 bp, mouse
gaagagacggaggcgagctg

SEQ ID NO: 853513 - DNA, 20 bp, mouse
gggctgggcgggttctggtg

SEQ ID NO: 853514 - DNA, 20 bp, mouse
ggcctccgtctcttccggtg

SEQ ID NO: 853515 - DNA, 20 bp, mouse
ggtgaggctaggtaagggga

SEQ ID NO: 853516 - DNA, 20 bp, mouse
gccagtggataagtagtaaa

SEQ ID NO: 853517 - DNA, 20 bp, mouse
gtccactgggaaaagttctc

SEQ ID NO: 853518 - DNA, 20 bp, mouse
gggaaaagttctcgggagag

SEQ ID NO: 853519 - DNA, 20 bp, mouse
gctggtgggcagagacctct

SEQ ID NO: 853520 - DNA, 20 bp, mouse
gttacactgtgttaccgcaa

SEQ ID NO: 853521 - DNA, 20 bp, mouse
gtcccgagaacttttcccag

SEQ ID NO: 853522 - DNA, 20 bp, mouse
gcaccagggctctgaactag

SEQ ID NO: 853523 - DNA, 20 bp, mouse
gagtgagctagcactcccag

SEQ ID NO: 853524 - DNA, 20 bp, mouse
gactgggaatctcgccctgg

SEQ ID NO: 853525 - DNA, 20 bp, mouse
gaaagttctcgggagagtgg

SEQ ID NO: 853526 - DNA, 20 bp, mouse
gaggggcggggctacgcaat

SEQ ID NO: 853527 - DNA, 20 bp, mouse
ggaggggaacaagtcggatg

SEQ ID NO: 853528 - DNA, 20 bp, mouse
gtccaggtggggaagcggta

SEQ ID NO: 853529 - DNA, 20 bp, mouse
gcctgggcggatgtgacccg

SEQ ID NO: 853530 - DNA, 20 bp, mouse
gaacaagtcggatggggatg

SEQ ID NO: 853531 - DNA, 20 bp, mouse
gcggggctacgcaatgggcg

SEQ ID NO: 853532 - DNA, 20 bp, mouse
gaggggtgggaatccctggg

SEQ ID NO: 853533 - DNA, 20 bp, mouse
gaggcgctagagtgtcatgt

SEQ ID NO: 853534 - DNA, 20 bp, mouse
gggtaggggtgggaatccct

SEQ ID NO: 853535 - DNA, 20 bp, mouse
gatgtgacccggggacaacc

SEQ ID NO: 853536 - DNA, 20 bp, mouse
gggaccggtggggcgaggat

SEQ ID NO: 853537 - DNA, 20 bp, mouse
gtcataaggggcgttgagac

SEQ ID NO: 853538 - DNA, 20 bp, mouse
gaccaggccggggtgcgcct

SEQ ID NO: 853539 - DNA, 20 bp, mouse
gggtgcgcctcggttgatgg

SEQ ID NO: 853540 - DNA, 20 bp, mouse
gcgaaaaagggtgcaactgt

SEQ ID NO: 853541 - DNA, 20 bp, mouse
gtcagaagcgagaccttgaa

SEQ ID NO: 853542 - DNA, 20 bp, mouse
ggtggggcgaggatgggtgt

SEQ ID NO: 853543 - DNA, 20 bp, mouse
gcatcgcgagcgtgagggag

SEQ ID NO: 853544 - DNA, 20 bp, mouse
gaagggcatcgcgagcgtga

SEQ ID NO: 853545 - DNA, 20 bp, mouse
gggttgatggcggaccggtg

SEQ ID NO: 853546 - DNA, 20 bp, mouse
gtaagcacgctgtgggttat

SEQ ID NO: 853547 - DNA, 20 bp, mouse
ggcggcctacgcggcatctc

SEQ ID NO: 853548 - DNA, 20 bp, mouse
ggtgcccagagatgccgcgt

SEQ ID NO: 853549 - DNA, 20 bp, mouse
gtgaaagatggcggcctacg

SEQ ID NO: 853550 - DNA, 20 bp, mouse
gaagctatgtaagcacgctg

SEQ ID NO: 853551 - DNA, 20 bp, mouse
gtacgcattccgtacagcag

SEQ ID NO: 853552 - DNA, 20 bp, mouse
gtggagtcctctggcatcgg

SEQ ID NO: 853553 - DNA, 20 bp, mouse
gtgaccttggtgcttgaagg

SEQ ID NO: 853554 - DNA, 20 bp, mouse
gaggacagagaagaatgcat

SEQ ID NO: 853555 - DNA, 20 bp, mouse
gatgttaatcgatcctccta

SEQ ID NO: 853556 - DNA, 20 bp, mouse
gctgaaccaaagaagtcaga

SEQ ID NO: 853557 - DNA, 20 bp, mouse
gcacagtttggggcggatat

SEQ ID NO: 853558 - DNA, 20 bp, mouse
gagtagccccccatctcttt

SEQ ID NO: 853559 - DNA, 20 bp, mouse
ggagatggggggctactcac

SEQ ID NO: 853560 - DNA, 20 bp, mouse
gcactaccaaaagagatggg

SEQ ID NO: 853561 - DNA, 20 bp, mouse
gcactgaaatccacagtttg

SEQ ID NO: 853562 - DNA, 20 bp, mouse
ggtcatggattgtatttaac

SEQ ID NO: 853563 - DNA, 20 bp, mouse
gcctaggcctcctttactcc

SEQ ID NO: 853564 - DNA, 20 bp, mouse
gacgtgtggacaagggacta

SEQ ID NO: 853565 - DNA, 20 bp, mouse
gtgtttacacggattaattg

SEQ ID NO: 853566 - DNA, 20 bp, mouse
gaggtgggatagatgagact

SEQ ID NO: 853567 - DNA, 20 bp, mouse
gtcggtcccgcccggcctgt

SEQ ID NO: 853568 - DNA, 20 bp, mouse
gccggcctgtcggctgcgat

SEQ ID NO: 853569 - DNA, 20 bp, mouse
ggggcctttagaatgatggt

SEQ ID NO: 853570 - DNA, 20 bp, mouse
ggaagggggcatgtctgggg

SEQ ID NO: 853571 - DNA, 20 bp, mouse
gcgttccacactcatcactt

SEQ ID NO: 853572 - DNA, 20 bp, mouse
gggacagaagggggcatgtc

SEQ ID NO: 853573 - DNA, 20 bp, mouse
ggaatcctaagtgatgagtg

SEQ ID NO: 853574 - DNA, 20 bp, mouse
gcctcggcctcggtcccgcc

SEQ ID NO: 853575 - DNA, 20 bp, mouse
gcggctgcgattggcctgag

SEQ ID NO: 853576 - DNA, 20 bp, mouse
ggagctgcgcaccgccggaa

SEQ ID NO: 853577 - DNA, 20 bp, mouse
gccgctgcggccggggacgg

SEQ ID NO: 853578 - DNA, 20 bp, mouse
gcggcaaccggccccgggtg

SEQ ID NO: 853579 - DNA, 20 bp, mouse
gagctccgcgctccgcgttc

SEQ ID NO: 853580 - DNA, 20 bp, mouse
gccgcagcggccatggcgct

SEQ ID NO: 853581 - DNA, 20 bp, mouse
gcgcgctccgcgttccggtc

SEQ ID NO: 853582 - DNA, 20 bp, mouse
gacgcctccagaccggaacg

SEQ ID NO: 853583 - DNA, 20 bp, mouse
gaaccggccccgggtgaggc

SEQ ID NO: 853584 - DNA, 20 bp, mouse
gggggcggacgcctccagac

SEQ ID NO: 853585 - DNA, 20 bp, mouse
gtgtccgggtccccttccgg

SEQ ID NO: 853586 - DNA, 20 bp, mouse
ggaaggaggcgggactacag

SEQ ID NO: 853587 - DNA, 20 bp, mouse
gaacacgccggggcactcgc

SEQ ID NO: 853588 - DNA, 20 bp, mouse
gtgggtaggcagcgctggac

SEQ ID NO: 853589 - DNA, 20 bp, mouse
gtccccgggagcgcgtcgca

SEQ ID NO: 853590 - DNA, 20 bp, mouse
gctgcctacccactgcctcg

SEQ ID NO: 853591 - DNA, 20 bp, mouse
gaggcgggactacagcggtt

SEQ ID NO: 853592 - DNA, 20 bp, mouse
gtaggctcgccacaatcgat

SEQ ID NO: 853593 - DNA, 20 bp, mouse
gctggacgggcgctgacggg

SEQ ID NO: 853594 - DNA, 20 bp, mouse
gcgctcccggctccggaagg

SEQ ID NO: 853595 - DNA, 20 bp, mouse
gatgccgcgaggcagtgggt

SEQ ID NO: 853596 - DNA, 20 bp, mouse
ggtcccgcggttctcccaca

SEQ ID NO: 853597 - DNA, 20 bp, mouse
gctaaaggatttctccgctg

SEQ ID NO: 853598 - DNA, 20 bp, mouse
gcgggcgtgggtgttgccgg

SEQ ID NO: 853599 - DNA, 20 bp, mouse
ggcggggttgggcagggcga

SEQ ID NO: 853600 - DNA, 20 bp, mouse
gcttgagcacaaggccccct

SEQ ID NO: 853601 - DNA, 20 bp, mouse
gtgggagtcctggtgacaat

SEQ ID NO: 853602 - DNA, 20 bp, mouse
gctcaagcaaagtccacttc

SEQ ID NO: 853603 - DNA, 20 bp, mouse
gaaaaccagctgggctctaa

SEQ ID NO: 853604 - DNA, 20 bp, mouse
gttggaggatgctgtgaatt

SEQ ID NO: 853605 - DNA, 20 bp, mouse
ggggtcttgtaaaaaccagc

SEQ ID NO: 853606 - DNA, 20 bp, mouse
gcgcccgcggcagtcactag

SEQ ID NO: 853607 - DNA, 20 bp, mouse
gggactgagctgggacgatc

SEQ ID NO: 853608 - DNA, 20 bp, mouse
gcccacccccgagggaatgc

SEQ ID NO: 853609 - DNA, 20 bp, mouse
gcgcccctagtgactgccgc

SEQ ID NO: 853610 - DNA, 20 bp, mouse
gagctgggacgatcaggcag

SEQ ID NO: 853611 - DNA, 20 bp, mouse
gagtgactgccgcgggcgga

SEQ ID NO: 853612 - DNA, 20 bp, mouse
gcattccagcattccctcgg

SEQ ID NO: 853613 - DNA, 20 bp, mouse
gcgggcggagggactgagct

SEQ ID NO: 853614 - DNA, 20 bp, mouse
gtgggcgcgttctctcactc

SEQ ID NO: 853615 - DNA, 20 bp, mouse
ggaatgctggaatggacgaa

SEQ ID NO: 853616 - DNA, 20 bp, mouse
gtggcatttggaagtctcta

SEQ ID NO: 853617 - DNA, 20 bp, mouse
gggcggcggtggcgccacag

SEQ ID NO: 853618 - DNA, 20 bp, mouse
gcgggtgcctgccactcaaa

SEQ ID NO: 853619 - DNA, 20 bp, mouse
ggcagtgcgtgctatatact

SEQ ID NO: 853620 - DNA, 20 bp, mouse
gctgccaccagtaacctcga

SEQ ID NO: 853621 - DNA, 20 bp, mouse
ggggaggagcaaggaaacgc

SEQ ID NO: 853622 - DNA, 20 bp, mouse
gaaaccggattcctagtctc

SEQ ID NO: 853623 - DNA, 20 bp, mouse
ggccaccgccgccatttgag

SEQ ID NO: 853624 - DNA, 20 bp, mouse
gtggcctgagactaggaatc

SEQ ID NO: 853625 - DNA, 20 bp, mouse
gcccggatgtacacgttttg

SEQ ID NO: 853626 - DNA, 20 bp, mouse
ggggctgctgggcgccgtga

SEQ ID NO: 853627 - DNA, 20 bp, mouse
ggtgcctcatgggtaggctc

SEQ ID NO: 853628 - DNA, 20 bp, mouse
gggtccccgcgtgtcctcgc

SEQ ID NO: 853629 - DNA, 20 bp, mouse
gcggccggcccgggccttcg

SEQ ID NO: 853630 - DNA, 20 bp, mouse
ggccgctccggctcccatcg

SEQ ID NO: 853631 - DNA, 20 bp, mouse
gcgctcgcctcccgcgttgg

SEQ ID NO: 853632 - DNA, 20 bp, mouse
ggtgtcctcgccggctgcta

SEQ ID NO: 853633 - DNA, 20 bp, mouse
ggccgtgctgcggacctcga

SEQ ID NO: 853634 - DNA, 20 bp, mouse
gtgggcgccgtgagggggga

SEQ ID NO: 853635 - DNA, 20 bp, mouse
gtccgtgtgcgagggttaaa

SEQ ID NO: 853636 - DNA, 20 bp, mouse
gccaaggggcgggaagtccg

SEQ ID NO: 853637 - DNA, 20 bp, mouse
ggggacttggaggcggacag

SEQ ID NO: 853638 - DNA, 20 bp, mouse
ggagctgctgggggctaggt

SEQ ID NO: 853639 - DNA, 20 bp, mouse
gcggttgggcggagctgctg

SEQ ID NO: 853640 - DNA, 20 bp, mouse
gcgcagcgaggggacgtgat

SEQ ID NO: 853641 - DNA, 20 bp, mouse
gacttggaggcggacagcgg

SEQ ID NO: 853642 - DNA, 20 bp, mouse
gtagggagaaggcgctccgg

SEQ ID NO: 853643 - DNA, 20 bp, mouse
gagcctgtcaatcaagcggg

SEQ ID NO: 853644 - DNA, 20 bp, mouse
gcaggcggaaactgaggcgc

SEQ ID NO: 853645 - DNA, 20 bp, mouse
ggattggtggccctgctgag

SEQ ID NO: 853646 - DNA, 20 bp, mouse
ggcggggagcgccaccgaag

SEQ ID NO: 853647 - DNA, 20 bp, mouse
gctggcgcgccggctgcgaa

SEQ ID NO: 853648 - DNA, 20 bp, mouse
ggagctcctgcccgcctgca

SEQ ID NO: 853649 - DNA, 20 bp, mouse
gtccccgctcgggccggcca

SEQ ID NO: 853650 - DNA, 20 bp, mouse
gggtcgccgtcagatttctt

SEQ ID NO: 853651 - DNA, 20 bp, mouse
ggagctgtccggccccggca

SEQ ID NO: 853652 - DNA, 20 bp, mouse
gagcaaacagtccccttcgg

SEQ ID NO: 853653 - DNA, 20 bp, mouse
gccaccccagccagacctag

SEQ ID NO: 853654 - DNA, 20 bp, mouse
ggcgcgccagccaatggcct

SEQ ID NO: 853655 - DNA, 20 bp, mouse
ggaccgccggcctctaggtc

SEQ ID NO: 853656 - DNA, 20 bp, mouse
ggtaacggaaggttgggacg

SEQ ID NO: 853657 - DNA, 20 bp, mouse
gtccctctcgcgagagaaaa

SEQ ID NO: 853658 - DNA, 20 bp, mouse
gggaatcccgcagtaacgga

SEQ ID NO: 853659 - DNA, 20 bp, mouse
ggcgtggaatcccgcagtaa

SEQ ID NO: 853660 - DNA, 20 bp, mouse
ggaaaaaggtgcatcgtgcg

SEQ ID NO: 853661 - DNA, 20 bp, mouse
gcccaaccttccgttactgc

SEQ ID NO: 853662 - DNA, 20 bp, mouse
gggcaggttgggaccacgag

SEQ ID NO: 853663 - DNA, 20 bp, mouse
gcacctttttctctcgcgag

SEQ ID NO: 853664 - DNA, 20 bp, mouse
ggatgtaattgtgcaaacaa

SEQ ID NO: 853665 - DNA, 20 bp, mouse
gtgccaagaaacagggggtc

SEQ ID NO: 853666 - DNA, 20 bp, mouse
gacaggcaagtcacggtgat

SEQ ID NO: 853667 - DNA, 20 bp, mouse
gagggcctggggctcgggat

SEQ ID NO: 853668 - DNA, 20 bp, mouse
gggcaagtcacggtgatggg

SEQ ID NO: 853669 - DNA, 20 bp, mouse
ggctcgggatgggaaggctc

SEQ ID NO: 853670 - DNA, 20 bp, mouse
gcctggggctcgggatggga

SEQ ID NO: 853671 - DNA, 20 bp, mouse
gaagtcacggtgatgggtgg

SEQ ID NO: 853672 - DNA, 20 bp, mouse
gtgccatagagacaggtcca

SEQ ID NO: 853673 - DNA, 20 bp, mouse
gtagacaggcatcaagtatg

SEQ ID NO: 853674 - DNA, 20 bp, mouse
gctgcgaagcccgggagcta

SEQ ID NO: 853675 - DNA, 20 bp, mouse
gctcgggttcggcttcccat

SEQ ID NO: 853676 - DNA, 20 bp, mouse
gctgcagcgagctgaagctg

SEQ ID NO: 853677 - DNA, 20 bp, mouse
gcgctgcagcactgccccgg

SEQ ID NO: 853678 - DNA, 20 bp, mouse
gcgcctgggcgcacgtacaa

SEQ ID NO: 853679 - DNA, 20 bp, mouse
gaagcgctctaggtgttgga

SEQ ID NO: 853680 - DNA, 20 bp, mouse
gcgtacaaaggccgggtgtg

SEQ ID NO: 853681 - DNA, 20 bp, mouse
ggcggcggcggctagggcca

SEQ ID NO: 853682 - DNA, 20 bp, mouse
gtgggcgcacgtacaaaggc

SEQ ID NO: 853683 - DNA, 20 bp, mouse
ggcaaggtctgcggaacagc

SEQ ID NO: 853684 - DNA, 20 bp, mouse
ggctcgctgcagcactgccc

SEQ ID NO: 853685 - DNA, 20 bp, mouse
ggtggggctggcgaccgccg

SEQ ID NO: 853686 - DNA, 20 bp, mouse
ggtgaaatcaaggcctgtgg

SEQ ID NO: 853687 - DNA, 20 bp, mouse
gcgggtgaaatcaaggcctg

SEQ ID NO: 853688 - DNA, 20 bp, mouse
gcatacaggtccctgggcag

SEQ ID NO: 853689 - DNA, 20 bp, mouse
gcactggggcggggtcttta

SEQ ID NO: 853690 - DNA, 20 bp, mouse
ggcgcgggatcccgatgcta

SEQ ID NO: 853691 - DNA, 20 bp, mouse
ggccttgatttcacccggga

SEQ ID NO: 853692 - DNA, 20 bp, mouse
gaccctcccgggtgaaatca

SEQ ID NO: 853693 - DNA, 20 bp, mouse
gaaggtatcaccagggccgg

SEQ ID NO: 853694 - DNA, 20 bp, mouse
gtcacgccccaagcgagaag

SEQ ID NO: 853695 - DNA, 20 bp, mouse
gtttacggggccagtctcgg

SEQ ID NO: 853696 - DNA, 20 bp, mouse
gtgtccgaccgggcgaagat

SEQ ID NO: 853697 - DNA, 20 bp, mouse
ggggaggtgaggcacaaacg

SEQ ID NO: 853698 - DNA, 20 bp, mouse
gcgaccggccctgtccgacc

SEQ ID NO: 853699 - DNA, 20 bp, mouse
ggcgaagatggggtgaatgt

SEQ ID NO: 853700 - DNA, 20 bp, mouse
ggggcggaagtgcatccccg

SEQ ID NO: 853701 - DNA, 20 bp, mouse
gcgcgcccctgacgtttccg

SEQ ID NO: 853702 - DNA, 20 bp, mouse
gcagcccacggaaacgtcag

SEQ ID NO: 853703 - DNA, 20 bp, mouse
gccgcactcgcgggaggaac

SEQ ID NO: 853704 - DNA, 20 bp, mouse
gggaaagctgagacgggcat

SEQ ID NO: 853705 - DNA, 20 bp, mouse
gggaggaccctgcgcgtcag

SEQ ID NO: 853706 - DNA, 20 bp, mouse
gctggacctcaaagcatctg

SEQ ID NO: 853707 - DNA, 20 bp, mouse
gagctcttggtcaggggaag

SEQ ID NO: 853708 - DNA, 20 bp, mouse
gtctgcccaatcctggatcc

SEQ ID NO: 853709 - DNA, 20 bp, mouse
gacagagggagtttggttcc

SEQ ID NO: 853710 - DNA, 20 bp, mouse
gggttccaggatccaggatt

SEQ ID NO: 853711 - DNA, 20 bp, mouse
ggaggtccagcgtggagcgt

SEQ ID NO: 853712 - DNA, 20 bp, mouse
gggcctggacagagggagtt

SEQ ID NO: 853713 - DNA, 20 bp, mouse
gcagaaatggccaagtcttt

SEQ ID NO: 853714 - DNA, 20 bp, mouse
gatgcccaaactagtataag

SEQ ID NO: 853715 - DNA, 20 bp, mouse
gttgtgcaggcctggacaga

SEQ ID NO: 853716 - DNA, 20 bp, mouse
gtctccctgcccaggggtcg

SEQ ID NO: 853717 - DNA, 20 bp, mouse
ggacagaggcacactaagac

SEQ ID NO: 853718 - DNA, 20 bp, mouse
ggcgctgacagcttcaggaa

SEQ ID NO: 853719 - DNA, 20 bp, mouse
gccaataagccgtgttttta

SEQ ID NO: 853720 - DNA, 20 bp, mouse
ggggcgacctttagagctaa

SEQ ID NO: 853721 - DNA, 20 bp, mouse
gaccaagaggagacgggatt

SEQ ID NO: 853722 - DNA, 20 bp, mouse
ggggtggggatacggagctg

SEQ ID NO: 853723 - DNA, 20 bp, mouse
gtatccccaccccgacccct

SEQ ID NO: 853724 - DNA, 20 bp, mouse
ggtctgctcccttaaaaaca

SEQ ID NO: 853725 - DNA, 20 bp, mouse
gggagataccaagaggagac

SEQ ID NO: 853726 - DNA, 20 bp, mouse
gcacgggcaaaggtagactt

SEQ ID NO: 853727 - DNA, 20 bp, mouse
gagcagggggtgctcattgt

SEQ ID NO: 853728 - DNA, 20 bp, mouse
gcgctggggctggacgtcgt

SEQ ID NO: 853729 - DNA, 20 bp, mouse
gcggagctctggatgtagac

SEQ ID NO: 853730 - DNA, 20 bp, mouse
gaggagcaggtaataagcag

SEQ ID NO: 853731 - DNA, 20 bp, mouse
ggggctggacgtcgtgggca

SEQ ID NO: 853732 - DNA, 20 bp, mouse
gcacgtcctggcacgggcaa

SEQ ID NO: 853733 - DNA, 20 bp, mouse
gcgagaagagatgctcgctg

SEQ ID NO: 853734 - DNA, 20 bp, mouse
gcctgacatgggcaagggtg

SEQ ID NO: 853735 - DNA, 20 bp, mouse
gcccacgaggggggcacttc

SEQ ID NO: 853736 - DNA, 20 bp, mouse
gaacgcttcggggaacagga

SEQ ID NO: 853737 - DNA, 20 bp, mouse
gttaatgagccgtgcattct

SEQ ID NO: 853738 - DNA, 20 bp, mouse
ggaagtctccgcggctaagg

SEQ ID NO: 853739 - DNA, 20 bp, mouse
ggaagtagaagccattgctt

SEQ ID NO: 853740 - DNA, 20 bp, mouse
gggaatgcttcagaacgctt

SEQ ID NO: 853741 - DNA, 20 bp, mouse
gcacgggcttaccagactga

SEQ ID NO: 853742 - DNA, 20 bp, mouse
gcggccctgacaagggttta

SEQ ID NO: 853743 - DNA, 20 bp, mouse
ggggaaatgtagtttctagt

SEQ ID NO: 853744 - DNA, 20 bp, mouse
gccttcacggcgtgcatctt

SEQ ID NO: 853745 - DNA, 20 bp, mouse
gcgtgcattcttggtgaact

SEQ ID NO: 853746 - DNA, 20 bp, mouse
gggagagcctgggaggacga

SEQ ID NO: 853747 - DNA, 20 bp, mouse
gggagccgggagccgtgggg

SEQ ID NO: 853748 - DNA, 20 bp, mouse
gtccagccgcgggagagcct

SEQ ID NO: 853749 - DNA, 20 bp, mouse
gccacggctcccggctcctg

SEQ ID NO: 853750 - DNA, 20 bp, mouse
ggagcctgcgcgagcaccag

SEQ ID NO: 853751 - DNA, 20 bp, mouse
gcgcgccgggaggaggagag

SEQ ID NO: 853752 - DNA, 20 bp, mouse
ggtcctcccaggctctcccg

SEQ ID NO: 853753 - DNA, 20 bp, mouse
gtgcgcggggccgaaaggcg

SEQ ID NO: 853754 - DNA, 20 bp, mouse
ggctctcccgcggctggacg

SEQ ID NO: 853755 - DNA, 20 bp, mouse
gcacaccccctcgtcctccc

SEQ ID NO: 853756 - DNA, 20 bp, mouse
gtggcccgagcctgtgggta

SEQ ID NO: 853757 - DNA, 20 bp, mouse
gcgagcctgtgggtacggag

SEQ ID NO: 853758 - DNA, 20 bp, mouse
gcctgtgggtacggaggggc

SEQ ID NO: 853759 - DNA, 20 bp, mouse
gcccgctggcccgagcctgt

SEQ ID NO: 853760 - DNA, 20 bp, mouse
gtcgccggagcctacggtcg

SEQ ID NO: 853761 - DNA, 20 bp, mouse
gcctccgcgaccgtaggctc

SEQ ID NO: 853762 - DNA, 20 bp, mouse
gccggctcctccgcgaccgt

SEQ ID NO: 853763 - DNA, 20 bp, mouse
ggagccggggatgaggatcc

SEQ ID NO: 853764 - DNA, 20 bp, mouse
gctccggcgagcggatcccg

SEQ ID NO: 853765 - DNA, 20 bp, mouse
ggagcgaggccgccccctgt

SEQ ID NO: 853766 - DNA, 20 bp, mouse
ggagctgaaaaggtagttgt

SEQ ID NO: 853767 - DNA, 20 bp, mouse
ggcacgtaactacccctcat

SEQ ID NO: 853768 - DNA, 20 bp, mouse
gagtgggccgagatgctgag

SEQ ID NO: 853769 - DNA, 20 bp, mouse
ggcaccggacctcccgaaat

SEQ ID NO: 853770 - DNA, 20 bp, mouse
gagggctgcaccgggattcc

SEQ ID NO: 853771 - DNA, 20 bp, mouse
gtgccctgcgcccggtactg

SEQ ID NO: 853772 - DNA, 20 bp, mouse
gaggtcggcaagccaaccgc

SEQ ID NO: 853773 - DNA, 20 bp, mouse
gtcggtcccacggtctccta

SEQ ID NO: 853774 - DNA, 20 bp, mouse
ggggcacggtttcaattcag

SEQ ID NO: 853775 - DNA, 20 bp, mouse
gtgctcggccccggaagctc

SEQ ID NO: 853776 - DNA, 20 bp, mouse
gcagctaaggctgggaggta

SEQ ID NO: 853777 - DNA, 20 bp, mouse
ggatacccgccatggatacc

SEQ ID NO: 853778 - DNA, 20 bp, mouse
ggggccaacgcggataggag

SEQ ID NO: 853779 - DNA, 20 bp, mouse
gcccgccatggataccagga

SEQ ID NO: 853780 - DNA, 20 bp, mouse
gagcactaacagagactcct

SEQ ID NO: 853781 - DNA, 20 bp, mouse
ggtagggagaaaagatgctt

SEQ ID NO: 853782 - DNA, 20 bp, mouse
gccagagcggggacctaccc

SEQ ID NO: 853783 - DNA, 20 bp, mouse
gaggcctggctgaaaccgga

SEQ ID NO: 853784 - DNA, 20 bp, mouse
gaggcaccctcctgtcattc

SEQ ID NO: 853785 - DNA, 20 bp, mouse
gtgacaggagggtgccttcc

SEQ ID NO: 853786 - DNA, 20 bp, mouse
ggggaagcgaggcagttgtc

SEQ ID NO: 853787 - DNA, 20 bp, mouse
gtggtgggcgggtctcgcga

SEQ ID NO: 853788 - DNA, 20 bp, mouse
ggctcctgggtcctgaccct

SEQ ID NO: 853789 - DNA, 20 bp, mouse
gaggcagttgtcaggctcct

SEQ ID NO: 853790 - DNA, 20 bp, mouse
gctgaccctggggatcgcgg

SEQ ID NO: 853791 - DNA, 20 bp, mouse
gccgtcccccgcgatcccca

SEQ ID NO: 853792 - DNA, 20 bp, mouse
ggagtgcggaaggctggaga

SEQ ID NO: 853793 - DNA, 20 bp, mouse
ggtcctgaccctggggatcg

SEQ ID NO: 853794 - DNA, 20 bp, mouse
gcccgcccaccaccccgcgt

SEQ ID NO: 853795 - DNA, 20 bp, mouse
gagagcaaccgggtccagga

SEQ ID NO: 853796 - DNA, 20 bp, mouse
gggagcaaggcattgcgatc

SEQ ID NO: 853797 - DNA, 20 bp, mouse
gctctcaaaagacagaatcg

SEQ ID NO: 853798 - DNA, 20 bp, mouse
ggcaccagtacctgcagctg

SEQ ID NO: 853799 - DNA, 20 bp, mouse
gtcctggagatgctgaggta

SEQ ID NO: 853800 - DNA, 20 bp, mouse
gcagaagcaactgaacctct

SEQ ID NO: 853801 - DNA, 20 bp, mouse
gaaaaggtgtcagattctcg

SEQ ID NO: 853802 - DNA, 20 bp, mouse
gcgacgcgcacgcgtcctag

SEQ ID NO: 853803 - DNA, 20 bp, mouse
gttaacaaaaacacgattat

SEQ ID NO: 853804 - DNA, 20 bp, mouse
gtgccctcaagaccagaaaa

SEQ ID NO: 853805 - DNA, 20 bp, mouse
gatgcagtaaataaaaaata

SEQ ID NO: 853806 - DNA, 20 bp, mouse
gtagcagaggccttgagatg

SEQ ID NO: 853807 - DNA, 20 bp, mouse
gcaggctcccagaaaggaaa

SEQ ID NO: 853808 - DNA, 20 bp, mouse
gaggagggggcggaacatgc

SEQ ID NO: 853809 - DNA, 20 bp, mouse
gttccgccccctcctcgggg

SEQ ID NO: 853810 - DNA, 20 bp, mouse
gaatcagaatgacatagcag

SEQ ID NO: 853811 - DNA, 20 bp, mouse
ggcccacaaaaaattttgag

SEQ ID NO: 853812 - DNA, 20 bp, mouse
gcgggtcctccccgaggagg

SEQ ID NO: 853813 - DNA, 20 bp, mouse
gggacccgccttcccggaag

SEQ ID NO: 853814 - DNA, 20 bp, mouse
ggagagctaaaaagtccaaa

SEQ ID NO: 853815 - DNA, 20 bp, mouse
gagcaagtccacttccggga

SEQ ID NO: 853816 - DNA, 20 bp, mouse
gacccagccgatagcctctg

SEQ ID NO: 853817 - DNA, 20 bp, mouse
gcatgcgcagagtctcggag

SEQ ID NO: 853818 - DNA, 20 bp, mouse
gtgggggccgcaactccctg

SEQ ID NO: 853819 - DNA, 20 bp, mouse
gcattcccacggttctccaa

SEQ ID NO: 853820 - DNA, 20 bp, mouse
gcgcctcagaggctatcggc

SEQ ID NO: 853821 - DNA, 20 bp, mouse
ggcaccctttggagaaccgt

SEQ ID NO: 853822 - DNA, 20 bp, mouse
ggatagcctctgaggcgcta

SEQ ID NO: 853823 - DNA, 20 bp, mouse
ggaggctatcggctgggtgg

SEQ ID NO: 853824 - DNA, 20 bp, mouse
gtgcgcatgcgcggtctcct

SEQ ID NO: 853825 - DNA, 20 bp, mouse
gcgcggtctcctaggctcta

SEQ ID NO: 853826 - DNA, 20 bp, mouse
gctgacctcagccctaacac

SEQ ID NO: 853827 - DNA, 20 bp, mouse
gctgcccggtgttagggctg

SEQ ID NO: 853828 - DNA, 20 bp, mouse
gctgaggtcagctgggtacg

SEQ ID NO: 853829 - DNA, 20 bp, mouse
gcacatgctgcccggtgtta

SEQ ID NO: 853830 - DNA, 20 bp, mouse
gagccgtcgtcgggtccagg

SEQ ID NO: 853831 - DNA, 20 bp, mouse
gaggactcagagccgtcgtc

SEQ ID NO: 853832 - DNA, 20 bp, mouse
ggtcctcctggacccgacga

SEQ ID NO: 853833 - DNA, 20 bp, mouse
gcggaggcgcccggctctcg

SEQ ID NO: 853834 - DNA, 20 bp, mouse
gcggagggctacacgggaag

SEQ ID NO: 853835 - DNA, 20 bp, mouse
ggaggtgtggctagacgctg

SEQ ID NO: 853836 - DNA, 20 bp, mouse
gggtgcgtgttgaagaactg

SEQ ID NO: 853837 - DNA, 20 bp, mouse
gggaggcgatgtgcgagcgc

SEQ ID NO: 853838 - DNA, 20 bp, mouse
ggtaacagacaatctcggtg

SEQ ID NO: 853839 - DNA, 20 bp, mouse
gagtcgagaggtgtgtgaat

SEQ ID NO: 853840 - DNA, 20 bp, mouse
gcgcacatcgcctcccaacg

SEQ ID NO: 853841 - DNA, 20 bp, mouse
gactgtgtgcagcgatcatg

SEQ ID NO: 853842 - DNA, 20 bp, mouse
gtggggtcggtgtccgcgtt

SEQ ID NO: 853843 - DNA, 20 bp, mouse
ggggttaagaagagcactga

SEQ ID NO: 853844 - DNA, 20 bp, mouse
gggggcaggggcttcggcgt

SEQ ID NO: 853845 - DNA, 20 bp, mouse
gcagcggggcaagctgtttc

SEQ ID NO: 853846 - DNA, 20 bp, mouse
ggagacccgcaggctattgg

SEQ ID NO: 853847 - DNA, 20 bp, mouse
gtgtgggaggagagacccgc

SEQ ID NO: 853848 - DNA, 20 bp, mouse
gggagagacccgcaggctat

SEQ ID NO: 853849 - DNA, 20 bp, mouse
gcagggttgctgcccatagt

SEQ ID NO: 853850 - DNA, 20 bp, mouse
gctgtcctccaatagcctgc

SEQ ID NO: 853851 - DNA, 20 bp, mouse
gtggactcagcaccactgga

SEQ ID NO: 853852 - DNA, 20 bp, mouse
gatcctctgaggtgcactgt

SEQ ID NO: 853853 - DNA, 20 bp, mouse
gtgcccatttctccccacta

SEQ ID NO: 853854 - DNA, 20 bp, mouse
ggaagtgattactgagtact

SEQ ID NO: 853855 - DNA, 20 bp, mouse
gaactacctagtgtacctag

SEQ ID NO: 853856 - DNA, 20 bp, mouse
ggctctgcagagtcccgctg

SEQ ID NO: 853857 - DNA, 20 bp, mouse
gctggggcggggccctgagg

SEQ ID NO: 853858 - DNA, 20 bp, mouse
gctgcagagtcccgctgggg

SEQ ID NO: 853859 - DNA, 20 bp, mouse
ggctaccacgagcagtgggt

SEQ ID NO: 853860 - DNA, 20 bp, mouse
gtggactcctaaggcgccag

SEQ ID NO: 853861 - DNA, 20 bp, mouse
gaccacgagcagtgggtggg

SEQ ID NO: 853862 - DNA, 20 bp, mouse
gaatgacaagtgtccgtcag

SEQ ID NO: 853863 - DNA, 20 bp, mouse
gggtgggcggggatttgacc

SEQ ID NO: 853864 - DNA, 20 bp, mouse
gttgatcacttcttagctca

SEQ ID NO: 853865 - DNA, 20 bp, mouse
gcatctcaatacacaggagg

SEQ ID NO: 853866 - DNA, 20 bp, mouse
gtgggaggatcacagctcta

SEQ ID NO: 853867 - DNA, 20 bp, mouse
ggggtcccctatgctaaagc

SEQ ID NO: 853868 - DNA, 20 bp, mouse
gcgactcccagctttagcat

SEQ ID NO: 853869 - DNA, 20 bp, mouse
gacagagcgcgtacttggga

SEQ ID NO: 853870 - DNA, 20 bp, mouse
ggccgctctaggaatgtggg

SEQ ID NO: 853871 - DNA, 20 bp, mouse
gcgctctgtgaattaggaac

SEQ ID NO: 853872 - DNA, 20 bp, mouse
gagtacgcgctctgtgaatt

SEQ ID NO: 853873 - DNA, 20 bp, mouse
gttggccgctctaggaatgt

SEQ ID NO: 853874 - DNA, 20 bp, mouse
gaagacaagtgggatgcggg

SEQ ID NO: 853875 - DNA, 20 bp, mouse
gactaagacaagtgggatgc

SEQ ID NO: 853876 - DNA, 20 bp, mouse
gcagggcatcatactgtcat

SEQ ID NO: 853877 - DNA, 20 bp, mouse
gttatgtggtagacaggagc

SEQ ID NO: 853878 - DNA, 20 bp, mouse
gagaatatgtgctggaggtc

SEQ ID NO: 853879 - DNA, 20 bp, mouse
gtcaggatagagaagttatg

SEQ ID NO: 853880 - DNA, 20 bp, mouse
ggcaggcagagaatatgtgc

SEQ ID NO: 853881 - DNA, 20 bp, mouse
gggcagagaatatgtgctgg

SEQ ID NO: 853882 - DNA, 20 bp, mouse
gaacatgtaaacaacctcag

SEQ ID NO: 853883 - DNA, 20 bp, mouse
gaccccagagctatagtgct

SEQ ID NO: 853884 - DNA, 20 bp, mouse
gaaacctagcactatagctc

SEQ ID NO: 853885 - DNA, 20 bp, mouse
gcagaagctctgactacatc

SEQ ID NO: 853886 - DNA, 20 bp, mouse
ggacaacacatccttaatct

SEQ ID NO: 853887 - DNA, 20 bp, mouse
gtacaaatatctaatcaaag

SEQ ID NO: 853888 - DNA, 20 bp, mouse
gtgcaattctgtcacgtgtt

SEQ ID NO: 853889 - DNA, 20 bp, mouse
gttgtccacttgaaaatatc

SEQ ID NO: 853890 - DNA, 20 bp, mouse
gaggttgtgatgtgttctct

SEQ ID NO: 853891 - DNA, 20 bp, mouse
gccacatttttctgagatca

SEQ ID NO: 853892 - DNA, 20 bp, mouse
gctttccagatattttcaag

SEQ ID NO: 853893 - DNA, 20 bp, mouse
ggattaagggtgtgttgtct

SEQ ID NO: 853894 - DNA, 20 bp, mouse
gggacaacacaccctaatcc

SEQ ID NO: 853895 - DNA, 20 bp, mouse
gggacaacacaccctaatcc

SEQ ID NO: 853896 - DNA, 20 bp, mouse
gaatcaaacacctgcttgtt

SEQ ID NO: 853897 - DNA, 20 bp, mouse
gattacttggaaggtcagag

SEQ ID NO: 853898 - DNA, 20 bp, mouse
gaaaagatgttgcaggttag

SEQ ID NO: 853899 - DNA, 20 bp, mouse
ggaaggtcagagtggacacc

SEQ ID NO: 853900 - DNA, 20 bp, mouse
gtctgggatttgaagttcct

SEQ ID NO: 853901 - DNA, 20 bp, mouse
gcaagcaggtgtttgattcc

SEQ ID NO: 853902 - DNA, 20 bp, mouse
gctccgcggccaccaccctc

SEQ ID NO: 853903 - DNA, 20 bp, mouse
gatgttgcaggttagtggaa

SEQ ID NO: 853904 - DNA, 20 bp, mouse
gaggctgaaggcagccacga

SEQ ID NO: 853905 - DNA, 20 bp, mouse
ggatgcacagattacttgga

SEQ ID NO: 853906 - DNA, 20 bp, mouse
gcggcctgatagatctcaca

SEQ ID NO: 853907 - DNA, 20 bp, mouse
gccaaactcccaaaaggccc

SEQ ID NO: 853908 - DNA, 20 bp, mouse
gccgcagctgcgcaccaaag

SEQ ID NO: 853909 - DNA, 20 bp, mouse
ggctggaggggggaataatg

SEQ ID NO: 853910 - DNA, 20 bp, mouse
gtcacagagctagtgacccg

SEQ ID NO: 853911 - DNA, 20 bp, mouse
ggggaaatgtagtttacctc

SEQ ID NO: 853912 - DNA, 20 bp, mouse
gctagtgacccggggccttt

SEQ ID NO: 853913 - DNA, 20 bp, mouse
gtcgagccacagacacccgg

SEQ ID NO: 853914 - DNA, 20 bp, mouse
gatgaggatagctgatgcag

SEQ ID NO: 853915 - DNA, 20 bp, mouse
gcctcgggactcaaggattc

SEQ ID NO: 853916 - DNA, 20 bp, mouse
gagggactgactgagagagc

SEQ ID NO: 853917 - DNA, 20 bp, mouse
gtcctagcaaacaagtctga

SEQ ID NO: 853918 - DNA, 20 bp, mouse
gcctggccccggtgccttct

SEQ ID NO: 853919 - DNA, 20 bp, mouse
gcgggagtagtagttctctg

SEQ ID NO: 853920 - DNA, 20 bp, mouse
gcgcgttctgaaagctgagt

SEQ ID NO: 853921 - DNA, 20 bp, mouse
gtgatgtgacaggacaaaag

SEQ ID NO: 853922 - DNA, 20 bp, mouse
gttaggagcgaggtacccat

SEQ ID NO: 853923 - DNA, 20 bp, mouse
gtccctcagacttgtttgct

SEQ ID NO: 853924 - DNA, 20 bp, mouse
gtctgactacacctcccaga

SEQ ID NO: 853925 - DNA, 20 bp, mouse
gttcagaacgcgcctggccc

SEQ ID NO: 853926 - DNA, 20 bp, mouse
gcactcccggggagcgagag

SEQ ID NO: 853927 - DNA, 20 bp, mouse
ggtggccctggtcgggacaa

SEQ ID NO: 853928 - DNA, 20 bp, mouse
gagctcgggtggccctggtc

SEQ ID NO: 853929 - DNA, 20 bp, mouse
ggccccgccaggcactcccg

SEQ ID NO: 853930 - DNA, 20 bp, mouse
ggggacaaaggcttggcccg

SEQ ID NO: 853931 - DNA, 20 bp, mouse
gcaagcctttgtcccgacca

SEQ ID NO: 853932 - DNA, 20 bp, mouse
ggcgccagctcgggtggccc

SEQ ID NO: 853933 - DNA, 20 bp, mouse
gggggcccgaaaagtcacat

SEQ ID NO: 853934 - DNA, 20 bp, mouse
ggatggagagtcaagatcgg

SEQ ID NO: 853935 - DNA, 20 bp, mouse
gtggagggttagggtggcgc

SEQ ID NO: 853936 - DNA, 20 bp, mouse
gaaggggcctagtaccaggc

SEQ ID NO: 853937 - DNA, 20 bp, mouse
gagctccggcccctctcggg

SEQ ID NO: 853938 - DNA, 20 bp, mouse
ggcagtcgggaagagaactg

SEQ ID NO: 853939 - DNA, 20 bp, mouse
gcaactggaggtgatggtag

SEQ ID NO: 853940 - DNA, 20 bp, mouse
gctgcgggagggccaagttc

SEQ ID NO: 853941 - DNA, 20 bp, mouse
gaagtgggggcagggctcta

SEQ ID NO: 853942 - DNA, 20 bp, mouse
gtctcggggggtagtaggga

SEQ ID NO: 853943 - DNA, 20 bp, mouse
gcccctctcggggggtagta

SEQ ID NO: 853944 - DNA, 20 bp, mouse
gccgcagctccggcccctct

SEQ ID NO: 853945 - DNA, 20 bp, mouse
gtgacaagggcagagactga

SEQ ID NO: 853946 - DNA, 20 bp, mouse
ggagcccccgtgctggggaa

SEQ ID NO: 853947 - DNA, 20 bp, mouse
gagcgcgagacgaggccccg

SEQ ID NO: 853948 - DNA, 20 bp, mouse
ggggctgcgcagccgagagg

SEQ ID NO: 853949 - DNA, 20 bp, mouse
gggcgccgcgcaactttcct

SEQ ID NO: 853950 - DNA, 20 bp, mouse
gggggcgcggagttcctttg

SEQ ID NO: 853951 - DNA, 20 bp, mouse
ggccgccaaggaaagttgcg

SEQ ID NO: 853952 - DNA, 20 bp, mouse
gctgcgcagccgagaggcgg

SEQ ID NO: 853953 - DNA, 20 bp, mouse
gccccggggctccggcgagt

SEQ ID NO: 853954 - DNA, 20 bp, mouse
ggccacccgggagcggagtc

SEQ ID NO: 853955 - DNA, 20 bp, mouse
ggccgcgcaactttccttgg

SEQ ID NO: 853956 - DNA, 20 bp, mouse
gcaagtgctcccagttgcag

SEQ ID NO: 853957 - DNA, 20 bp, mouse
gcaactgggagcacttgcct

SEQ ID NO: 853958 - DNA, 20 bp, mouse
gttgcaggggcggcgaaagt

SEQ ID NO: 853959 - DNA, 20 bp, mouse
ggaaagagctgccagcagga

SEQ ID NO: 853960 - DNA, 20 bp, mouse
ggcgaaagtgggcgtgaaga

SEQ ID NO: 853961 - DNA, 20 bp, mouse
gccccgatggggtggaccca

SEQ ID NO: 853962 - DNA, 20 bp, mouse
gacccctgggtccaccccat

SEQ ID NO: 853963 - DNA, 20 bp, mouse
gcccgctagaggggccccga

SEQ ID NO: 853964 - DNA, 20 bp, mouse
gacatcacggggagggatgc

SEQ ID NO: 853965 - DNA, 20 bp, mouse
ggcaggatggtccctgggga

SEQ ID NO: 853966 - DNA, 20 bp, mouse
gacaaaatgttggaagggga

SEQ ID NO: 853967 - DNA, 20 bp, mouse
ggtaccttcgggaagaagga

SEQ ID NO: 853968 - DNA, 20 bp, mouse
gcaactctgactctcagtga

SEQ ID NO: 853969 - DNA, 20 bp, mouse
gtctcagtgagggaaagtct

SEQ ID NO: 853970 - DNA, 20 bp, mouse
gccagggcagagagtatatc

SEQ ID NO: 853971 - DNA, 20 bp, mouse
gggacatgaaaacccctgag

SEQ ID NO: 853972 - DNA, 20 bp, mouse
gaggaaaagtcagaaggcct

SEQ ID NO: 853973 - DNA, 20 bp, mouse
ggcactgtgccctttggtaa

SEQ ID NO: 853974 - DNA, 20 bp, mouse
gtctgtaaggcagacaccag

SEQ ID NO: 853975 - DNA, 20 bp, mouse
gggctgctgggctaaccaag

SEQ ID NO: 853976 - DNA, 20 bp, mouse
gagagccaatagccgggtcc

SEQ ID NO: 853977 - DNA, 20 bp, mouse
gggccaccgcgacgagtgac

SEQ ID NO: 853978 - DNA, 20 bp, mouse
gagagcggcggccaatgacg

SEQ ID NO: 853979 - DNA, 20 bp, mouse
ggtgtcgggcggggaggacg

SEQ ID NO: 853980 - DNA, 20 bp, mouse
gcaaaaaagtatgagagcgg

SEQ ID NO: 853981 - DNA, 20 bp, mouse
gtggttccgccccctccgga

SEQ ID NO: 853982 - DNA, 20 bp, mouse
ggcggcaggttgttattctc

SEQ ID NO: 853983 - DNA, 20 bp, mouse
ggctgtgttccgtccggagg

SEQ ID NO: 853984 - DNA, 20 bp, mouse
ggcggcctggggcccgttaa

SEQ ID NO: 853985 - DNA, 20 bp, mouse
gcaggcgcgaaatgtaacgc

SEQ ID NO: 853986 - DNA, 20 bp, mouse
ggacagagaccgagactagg

SEQ ID NO: 853987 - DNA, 20 bp, mouse
gtcgagcggcggcaatctgt

SEQ ID NO: 853988 - DNA, 20 bp, mouse
ggggactggctgtgggtcga

SEQ ID NO: 853989 - DNA, 20 bp, mouse
ggtccgtaagcgtctgctac

SEQ ID NO: 853990 - DNA, 20 bp, mouse
gagcagacgcttacggactt

SEQ ID NO: 853991 - DNA, 20 bp, mouse
gggaccagcgagccgactca

SEQ ID NO: 853992 - DNA, 20 bp, mouse
ggagggacccggatggggac

SEQ ID NO: 853993 - DNA, 20 bp, mouse
gagaggggagggacccggat

SEQ ID NO: 853994 - DNA, 20 bp, mouse
ggctggtgttagatcggctg

SEQ ID NO: 853995 - DNA, 20 bp, mouse
gctgttggcgtccttcctgt

SEQ ID NO: 853996 - DNA, 20 bp, mouse
ggccatgcggtcaagaggga

SEQ ID NO: 853997 - DNA, 20 bp, mouse
ggagcagcgaggttgacaaa

SEQ ID NO: 853998 - DNA, 20 bp, mouse
gccgggctcggcccagggga

SEQ ID NO: 853999 - DNA, 20 bp, mouse
gcctgggccgagcccggcag

SEQ ID NO: 854000 - DNA, 20 bp, mouse
gagcgaggttgacaaagggt

SEQ ID NO: 854001 - DNA, 20 bp, mouse
ggtcacagagccgagcagcg

SEQ ID NO: 854002 - DNA, 20 bp, mouse
gcccaggggaggggcgcccc

SEQ ID NO: 854003 - DNA, 20 bp, mouse
gaatcagccatgcggtcaag

SEQ ID NO: 854004 - DNA, 20 bp, mouse
gacaactcgaactccgaagg

SEQ ID NO: 854005 - DNA, 20 bp, mouse
ggggcagccgggtgtggaca

SEQ ID NO: 854006 - DNA, 20 bp, mouse
gagaaggagcctgacgtccg

SEQ ID NO: 854007 - DNA, 20 bp, mouse
gcccgaaggggaaaaattgg

SEQ ID NO: 854008 - DNA, 20 bp, mouse
ggcggggcaaagcgcaccgg

SEQ ID NO: 854009 - DNA, 20 bp, mouse
gtcccccgaaggggaaaaat

SEQ ID NO: 854010 - DNA, 20 bp, mouse
gccgctccggggctgtataa

SEQ ID NO: 854011 - DNA, 20 bp, mouse
gctgaccggccggggtctcc

SEQ ID NO: 854012 - DNA, 20 bp, mouse
gtgggcgtcccgagcggcgt

SEQ ID NO: 854013 - DNA, 20 bp, mouse
ggcggcggggcaaagcgcac

SEQ ID NO: 854014 - DNA, 20 bp, mouse
gaacgccgcccgccagcccg

SEQ ID NO: 854015 - DNA, 20 bp, mouse
gtcccgggtagccccgtcct

SEQ ID NO: 854016 - DNA, 20 bp, mouse
gcccagcaggagggctgggt

SEQ ID NO: 854017 - DNA, 20 bp, mouse
ggacccggagaaaccttcga

SEQ ID NO: 854018 - DNA, 20 bp, mouse
gagggcaggtaggcggagct

SEQ ID NO: 854019 - DNA, 20 bp, mouse
gccagcccagcaggagggct

SEQ ID NO: 854020 - DNA, 20 bp, mouse
gccggagaaaccttcgaggg

SEQ ID NO: 854021 - DNA, 20 bp, mouse
ggtgcaggtacgccaccaag

SEQ ID NO: 854022 - DNA, 20 bp, mouse
gccagcgagctccaaacatg

SEQ ID NO: 854023 - DNA, 20 bp, mouse
gcaggtacgccaccaagtgg

SEQ ID NO: 854024 - DNA, 20 bp, mouse
gtgaggcaaaaagggcaggt

SEQ ID NO: 854025 - DNA, 20 bp, mouse
gcagcggaggaacattaact

SEQ ID NO: 854026 - DNA, 20 bp, mouse
gggaccccgccgtacaacgg

SEQ ID NO: 854027 - DNA, 20 bp, mouse
gcggggaggcctcgcctcgg

SEQ ID NO: 854028 - DNA, 20 bp, mouse
gcctcccgaatttaggtctg

SEQ ID NO: 854029 - DNA, 20 bp, mouse
gcgcccgcgcctccgttgta

SEQ ID NO: 854030 - DNA, 20 bp, mouse
gtgggatcactgtgccggca

SEQ ID NO: 854031 - DNA, 20 bp, mouse
gggtccgggggcttcgatgg

SEQ ID NO: 854032 - DNA, 20 bp, mouse
gcggagctgcgacgtgtccc

SEQ ID NO: 854033 - DNA, 20 bp, mouse
gcacgaatcgccagccctgc

SEQ ID NO: 854034 - DNA, 20 bp, mouse
gaccccgggcaccgcttcag

SEQ ID NO: 854035 - DNA, 20 bp, mouse
ggcaccccagacctaaattc

SEQ ID NO: 854036 - DNA, 20 bp, mouse
ggggacgctggtgcaagcgc

SEQ ID NO: 854037 - DNA, 20 bp, mouse
gtggtgcaagcgcggggcga

SEQ ID NO: 854038 - DNA, 20 bp, mouse
gcaccagcgtccccttggct

SEQ ID NO: 854039 - DNA, 20 bp, mouse
gtcccacccgccccagccaa

SEQ ID NO: 854040 - DNA, 20 bp, mouse
gacggtctgtggccgcgcgc

SEQ ID NO: 854041 - DNA, 20 bp, mouse
gggcgcgcgcggcaactaac

SEQ ID NO: 854042 - DNA, 20 bp, mouse
gcgcggccacagaccgtagc

SEQ ID NO: 854043 - DNA, 20 bp, mouse
gagtctcagagctcccctgt

SEQ ID NO: 854044 - DNA, 20 bp, mouse
gctcccaggagcctccgggg

SEQ ID NO: 854045 - DNA, 20 bp, mouse
gcggttcgagacgttgggag

SEQ ID NO: 854046 - DNA, 20 bp, mouse
gaaaggacatgtggacgttg

SEQ ID NO: 854047 - DNA, 20 bp, mouse
gaggtctgggcgtgtgacgc

SEQ ID NO: 854048 - DNA, 20 bp, mouse
gcacacgcccagacctggct

SEQ ID NO: 854049 - DNA, 20 bp, mouse
gctggtgacagatgagccca

SEQ ID NO: 854050 - DNA, 20 bp, mouse
gtgttcctctggacttgaga

SEQ ID NO: 854051 - DNA, 20 bp, mouse
gcaggttcctcggaatcctc

SEQ ID NO: 854052 - DNA, 20 bp, mouse
gaggtttccaagccaggtct

SEQ ID NO: 854053 - DNA, 20 bp, mouse
gtcctcggaatcctctggtt

SEQ ID NO: 854054 - DNA, 20 bp, mouse
gtagaactgataaagattag

SEQ ID NO: 854055 - DNA, 20 bp, mouse
ggaatcctctggtttggaag

SEQ ID NO: 854056 - DNA, 20 bp, mouse
gggcgcgcgagacacccgca

SEQ ID NO: 854057 - DNA, 20 bp, mouse
ggcacattgaagctgttggg

SEQ ID NO: 854058 - DNA, 20 bp, mouse
gtcacccggaagtggtgctg

SEQ ID NO: 854059 - DNA, 20 bp, mouse
ggcgccgcccggccgagcgt

SEQ ID NO: 854060 - DNA, 20 bp, mouse
gagtgggcgtggaggactcg

SEQ ID NO: 854061 - DNA, 20 bp, mouse
gagcacatccggtgctgtta

SEQ ID NO: 854062 - DNA, 20 bp, mouse
gggggcgcgaggcgaggtgt

SEQ ID NO: 854063 - DNA, 20 bp, mouse
gtgagtgtccaggagggcgg

SEQ ID NO: 854064 - DNA, 20 bp, mouse
gtccgggtgagtgtccagga

SEQ ID NO: 854065 - DNA, 20 bp, mouse
ggaaggcagcgtgtgttaaa

SEQ ID NO: 854066 - DNA, 20 bp, mouse
gaaaggctggaggaagcggg

SEQ ID NO: 854067 - DNA, 20 bp, mouse
gattgggggcggtaactgaa

SEQ ID NO: 854068 - DNA, 20 bp, mouse
ggcaccccgggctccgcgag

SEQ ID NO: 854069 - DNA, 20 bp, mouse
gacgccccctcgcggagccc

SEQ ID NO: 854070 - DNA, 20 bp, mouse
gcgcggagcccggggtgcca

SEQ ID NO: 854071 - DNA, 20 bp, mouse
gggtgccagggtgccccctc

SEQ ID NO: 854072 - DNA, 20 bp, mouse
gagtggctcagtctgagggc

SEQ ID NO: 854073 - DNA, 20 bp, mouse
gtcggactcggggtacaggg

SEQ ID NO: 854074 - DNA, 20 bp, mouse
gaacagagcccgggttgagt

SEQ ID NO: 854075 - DNA, 20 bp, mouse
gacagcaggtgaagaccgga

SEQ ID NO: 854076 - DNA, 20 bp, mouse
gtggatgggcaggagttaac

SEQ ID NO: 854077 - DNA, 20 bp, mouse
ggacagggcccggtcatgtg

SEQ ID NO: 854078 - DNA, 20 bp, mouse
gcaggagttaacgggacaga

SEQ ID NO: 854079 - DNA, 20 bp, mouse
gctagctaaggccttgtgga

SEQ ID NO: 854080 - DNA, 20 bp, mouse
ggagttaacgggacagaggg

SEQ ID NO: 854081 - DNA, 20 bp, mouse
ggggttcagaatgggttccc

SEQ ID NO: 854082 - DNA, 20 bp, mouse
gtaactcctgcccatccaca

SEQ ID NO: 854083 - DNA, 20 bp, mouse
gctgaacccagtgaaaggac

SEQ ID NO: 854084 - DNA, 20 bp, mouse
gcgggccctgtcctttcact

SEQ ID NO: 854085 - DNA, 20 bp, mouse
gctttcactgggttcagaat

SEQ ID NO: 854086 - DNA, 20 bp, mouse
gcggccagtaggtgacacgt

SEQ ID NO: 854087 - DNA, 20 bp, mouse
ggggcagagcccatacttgg

SEQ ID NO: 854088 - DNA, 20 bp, mouse
gagcctccagcaggggtcgg

SEQ ID NO: 854089 - DNA, 20 bp, mouse
ggggccgacgtgtcacctac

SEQ ID NO: 854090 - DNA, 20 bp, mouse
gcgggggcagagcccatact

SEQ ID NO: 854091 - DNA, 20 bp, mouse
gagcctcgcaggtccttgct

SEQ ID NO: 854092 - DNA, 20 bp, mouse
gcccgcgccgagcgcctcgc

SEQ ID NO: 854093 - DNA, 20 bp, mouse
gcgctcggcgcgggatgctg

SEQ ID NO: 854094 - DNA, 20 bp, mouse
gtgcgcgcctggcctcgccc

SEQ ID NO: 854095 - DNA, 20 bp, mouse
gccgcgcgggccacggggac

SEQ ID NO: 854096 - DNA, 20 bp, mouse
gccaagctgtgggactgtga

SEQ ID NO: 854097 - DNA, 20 bp, mouse
ggagcctggggcacaggagg

SEQ ID NO: 854098 - DNA, 20 bp, mouse
ggcaggggtgaggtgtgtga

SEQ ID NO: 854099 - DNA, 20 bp, mouse
gccagagcaggggcgcattc

SEQ ID NO: 854100 - DNA, 20 bp, mouse
gttgtcagcaaagacctcca

SEQ ID NO: 854101 - DNA, 20 bp, mouse
ggcctcttctgctgaaacaa

SEQ ID NO: 854102 - DNA, 20 bp, mouse
ggacctgtggtctaaataag

SEQ ID NO: 854103 - DNA, 20 bp, mouse
gtgactataaggtgatgtcc

SEQ ID NO: 854104 - DNA, 20 bp, mouse
gcattcaggcacgcagtgca

SEQ ID NO: 854105 - DNA, 20 bp, mouse
gggctccctccttatctcag

SEQ ID NO: 854106 - DNA, 20 bp, mouse
gtggactcgcgatattgtca

SEQ ID NO: 854107 - DNA, 20 bp, mouse
gtcgacggatttagtttcca

SEQ ID NO: 854108 - DNA, 20 bp, mouse
gcggccgaatgaggtccgaa

SEQ ID NO: 854109 - DNA, 20 bp, mouse
gggtccgaaaggcaagttct

SEQ ID NO: 854110 - DNA, 20 bp, mouse
gtcgcaaggcataacgaaga

SEQ ID NO: 854111 - DNA, 20 bp, mouse
ggaaaagccacaggtcgccc

SEQ ID NO: 854112 - DNA, 20 bp, mouse
gcgaagcccgcctcaaaaac

SEQ ID NO: 854113 - DNA, 20 bp, mouse
ggatgtcaatcaagatcagg

SEQ ID NO: 854114 - DNA, 20 bp, mouse
gtcaatcaagatcaggaggg

SEQ ID NO: 854115 - DNA, 20 bp, mouse
gcatcctagaacttgccttt

SEQ ID NO: 854116 - DNA, 20 bp, mouse
gaaggcccgcccctgtgccc

SEQ ID NO: 854117 - DNA, 20 bp, mouse
gtcgcagcagccactttttg

SEQ ID NO: 854118 - DNA, 20 bp, mouse
gactgaggggcggtccaatc

SEQ ID NO: 854119 - DNA, 20 bp, mouse
gccaatcgatgacttgagaa

SEQ ID NO: 854120 - DNA, 20 bp, mouse
gatgatggggcggggactga

SEQ ID NO: 854121 - DNA, 20 bp, mouse
gcaatcaaggcacgatgatg

SEQ ID NO: 854122 - DNA, 20 bp, mouse
gcatcgattggtgctatctg

SEQ ID NO: 854123 - DNA, 20 bp, mouse
gggcagactaccccaaaaag

SEQ ID NO: 854124 - DNA, 20 bp, mouse
gtcaaggcacgatgatgggg

SEQ ID NO: 854125 - DNA, 20 bp, mouse
ggagcgcagcccgggcacag

SEQ ID NO: 854126 - DNA, 20 bp, mouse
gtcaagtgcgcatgtgtgag

SEQ ID NO: 854127 - DNA, 20 bp, mouse
ggcgcgcgcgcgcacgtccg

SEQ ID NO: 854128 - DNA, 20 bp, mouse
ggctcggcgcgctcccttcc

SEQ ID NO: 854129 - DNA, 20 bp, mouse
gcgcgcgcacgtccggggct

SEQ ID NO: 854130 - DNA, 20 bp, mouse
gtaccgccaagcagggtgtg

SEQ ID NO: 854131 - DNA, 20 bp, mouse
gggctggctcgcgggcggac

SEQ ID NO: 854132 - DNA, 20 bp, mouse
gcgggcggactggctgcgag

SEQ ID NO: 854133 - DNA, 20 bp, mouse
gctgcttggcggtacacagt

SEQ ID NO: 854134 - DNA, 20 bp, mouse
gccgcgagccagccagacgc

SEQ ID NO: 854135 - DNA, 20 bp, mouse
ggagcgcagtgtcccggaga

SEQ ID NO: 854136 - DNA, 20 bp, mouse
gtgagcgagaagggagagac

SEQ ID NO: 854137 - DNA, 20 bp, mouse
gggagccccagctacagcgg

SEQ ID NO: 854138 - DNA, 20 bp, mouse
gactgggaaactgagcgaga

SEQ ID NO: 854139 - DNA, 20 bp, mouse
gtgtgcgcgcgcgagcggaa

SEQ ID NO: 854140 - DNA, 20 bp, mouse
gctgatgagagtaaacctgt

SEQ ID NO: 854141 - DNA, 20 bp, mouse
gggacgcaggcgagcggaag

SEQ ID NO: 854142 - DNA, 20 bp, mouse
ggacgcgcctcaggcctttg

SEQ ID NO: 854143 - DNA, 20 bp, mouse
ggaaaatccgattatgggac

SEQ ID NO: 854144 - DNA, 20 bp, mouse
gcgtaggcgcgtgcccgagg

SEQ ID NO: 854145 - DNA, 20 bp, mouse
gtgctcctccgctgtagctg

SEQ ID NO: 854146 - DNA, 20 bp, mouse
gccctggcggcccccgcatc

SEQ ID NO: 854147 - DNA, 20 bp, mouse
ggacctctgggaaggcgctc

SEQ ID NO: 854148 - DNA, 20 bp, mouse
gctgtcccgggaggaccgac

SEQ ID NO: 854149 - DNA, 20 bp, mouse
gccctccggtcggtcctccc

SEQ ID NO: 854150 - DNA, 20 bp, mouse
ggaaggcgctccggatgcgg

SEQ ID NO: 854151 - DNA, 20 bp, mouse
gtctgctgggtcttctcaga

SEQ ID NO: 854152 - DNA, 20 bp, mouse
gatccggagcgccttcccag

SEQ ID NO: 854153 - DNA, 20 bp, mouse
gggctggacgatagtgtaat

SEQ ID NO: 854154 - DNA, 20 bp, mouse
gatggatgggaaacccgagt

SEQ ID NO: 854155 - DNA, 20 bp, mouse
gcagcctggacaccgctccc

SEQ ID NO: 854156 - DNA, 20 bp, mouse
gagaagagcttgggaggggt

SEQ ID NO: 854157 - DNA, 20 bp, mouse
gcgtgtggtgggcggagcta

SEQ ID NO: 854158 - DNA, 20 bp, mouse
gtccccggtccctcagtgaa

SEQ ID NO: 854159 - DNA, 20 bp, mouse
gctgcgaggtccggaatccg

SEQ ID NO: 854160 - DNA, 20 bp, mouse
ggcccaccacacgctggttc

SEQ ID NO: 854161 - DNA, 20 bp, mouse
ggctggttccggttacgtga

SEQ ID NO: 854162 - DNA, 20 bp, mouse
gtgtcagcaagcctggtagg

SEQ ID NO: 854163 - DNA, 20 bp, mouse
ggagctagggcggtgctcca

SEQ ID NO: 854164 - DNA, 20 bp, mouse
gaaccggaaccagcgtgtgg

SEQ ID NO: 854165 - DNA, 20 bp, mouse
gacagctagagctgtgtgac

SEQ ID NO: 854166 - DNA, 20 bp, mouse
gagagccgccggccattcga

SEQ ID NO: 854167 - DNA, 20 bp, mouse
gactacgctggatggagcac

SEQ ID NO: 854168 - DNA, 20 bp, mouse
gacttccggaaagtaccgct

SEQ ID NO: 854169 - DNA, 20 bp, mouse
ggtggcggccggttcttcgt

SEQ ID NO: 854170 - DNA, 20 bp, mouse
gggtgctgcggggacggttc

SEQ ID NO: 854171 - DNA, 20 bp, mouse
ggcggccggttcttcgtcgg

SEQ ID NO: 854172 - DNA, 20 bp, mouse
gctccccgctggaagggaaa

SEQ ID NO: 854173 - DNA, 20 bp, mouse
gagtcggcctagagcctctg

SEQ ID NO: 854174 - DNA, 20 bp, mouse
gccacttccggcggttccca

SEQ ID NO: 854175 - DNA, 20 bp, mouse
gtcaccgtcttccctctggg

SEQ ID NO: 854176 - DNA, 20 bp, mouse
gagcgggcctctgaaatcct

SEQ ID NO: 854177 - DNA, 20 bp, mouse
gtcgtatcgcccatcggaca

SEQ ID NO: 854178 - DNA, 20 bp, mouse
gaacccaactcactcacttt

SEQ ID NO: 854179 - DNA, 20 bp, mouse
gtccagatgcaggaaactag

SEQ ID NO: 854180 - DNA, 20 bp, mouse
gggtggttaggcatcattga

SEQ ID NO: 854181 - DNA, 20 bp, mouse
gtaagctcaaggaagaatcc

SEQ ID NO: 854182 - DNA, 20 bp, mouse
ggttaggcatcattgaagga

SEQ ID NO: 854183 - DNA, 20 bp, mouse
gaaggatggacctgggagtt

SEQ ID NO: 854184 - DNA, 20 bp, mouse
gccggctccgagatgggaat

SEQ ID NO: 854185 - DNA, 20 bp, mouse
gttgctgcccggaccaaaca

SEQ ID NO: 854186 - DNA, 20 bp, mouse
gacccttgccgggttctcgg

SEQ ID NO: 854187 - DNA, 20 bp, mouse
gcagaagggcgtgaacgagc

SEQ ID NO: 854188 - DNA, 20 bp, mouse
gtctccccgccccttcgggt

SEQ ID NO: 854189 - DNA, 20 bp, mouse
gagagccgacccgaaggggc

SEQ ID NO: 854190 - DNA, 20 bp, mouse
gcctagagcggcactggagt

SEQ ID NO: 854191 - DNA, 20 bp, mouse
gctcctagagcgacaccaga

SEQ ID NO: 854192 - DNA, 20 bp, mouse
ggggcgtgaacgagcaggcg

SEQ ID NO: 854193 - DNA, 20 bp, mouse
ggggcctacggccgcagcac

SEQ ID NO: 854194 - DNA, 20 bp, mouse
gcacgggatcacagagaggc

SEQ ID NO: 854195 - DNA, 20 bp, mouse
ggcagcacgggatcacagag

SEQ ID NO: 854196 - DNA, 20 bp, mouse
gggaaccctgtgtgtgtctc

SEQ ID NO: 854197 - DNA, 20 bp, mouse
gccgcccgcgggtgtttctc

SEQ ID NO: 854198 - DNA, 20 bp, mouse
gggcggagaagaaagcgagt

SEQ ID NO: 854199 - DNA, 20 bp, mouse
gacggggcgctgcggttcct

SEQ ID NO: 854200 - DNA, 20 bp, mouse
gaggaggggacggggcgctg

SEQ ID NO: 854201 - DNA, 20 bp, mouse
gtgtatgtagcggggagcga

SEQ ID NO: 854202 - DNA, 20 bp, mouse
ggggccgcggcggctgggat

SEQ ID NO: 854203 - DNA, 20 bp, mouse
gcccgcgggtgtttctcagg

SEQ ID NO: 854204 - DNA, 20 bp, mouse
gaggaggaggcgctgactct

SEQ ID NO: 854205 - DNA, 20 bp, mouse
gagaaccctgaagggcagac

SEQ ID NO: 854206 - DNA, 20 bp, mouse
gcaacctgggctataaaagt

SEQ ID NO: 854207 - DNA, 20 bp, mouse
gaagagcagcgggactgaca

SEQ ID NO: 854208 - DNA, 20 bp, mouse
ggggcgcttctctagaagga

SEQ ID NO: 854209 - DNA, 20 bp, mouse
gtctcgcgagatctgagaag

SEQ ID NO: 854210 - DNA, 20 bp, mouse
gcgcggacgcggaagagcag

SEQ ID NO: 854211 - DNA, 20 bp, mouse
gcagaggtgtaactgagtag

SEQ ID NO: 854212 - DNA, 20 bp, mouse
ggatctgagaagcgggaaaa

SEQ ID NO: 854213 - DNA, 20 bp, mouse
gtagagaagcgcccagaatt

SEQ ID NO: 854214 - DNA, 20 bp, mouse
gcagcgggactgacagggaa

SEQ ID NO: 854215 - DNA, 20 bp, mouse
gtagctagctaggtgggaac

SEQ ID NO: 854216 - DNA, 20 bp, mouse
gaatgtagttcctactgctc

SEQ ID NO: 854217 - DNA, 20 bp, mouse
gctgcagtaaaggaagagtg

SEQ ID NO: 854218 - DNA, 20 bp, mouse
gcattgtgaggatggattat

SEQ ID NO: 854219 - DNA, 20 bp, mouse
gaaggtcgacagacattggg

SEQ ID NO: 854220 - DNA, 20 bp, mouse
gtgggaaggtcgacagacat

SEQ ID NO: 854221 - DNA, 20 bp, mouse
ggaagagtggggattttatt

SEQ ID NO: 854222 - DNA, 20 bp, mouse
ggatgtgtcagcattgcatc

SEQ ID NO: 854223 - DNA, 20 bp, mouse
ggggcagtttctgcctggga

SEQ ID NO: 854224 - DNA, 20 bp, mouse
gatggattatgggctgctgt

SEQ ID NO: 854225 - DNA, 20 bp, mouse
gaggcagaaactgccctctt

SEQ ID NO: 854226 - DNA, 20 bp, mouse
gctgtccccttgtcttgggt

SEQ ID NO: 854227 - DNA, 20 bp, mouse
gcacgccgacccaagacaag

SEQ ID NO: 854228 - DNA, 20 bp, mouse
gacaaggggacagctctggg

SEQ ID NO: 854229 - DNA, 20 bp, mouse
gagtctcaaggccaggcgat

SEQ ID NO: 854230 - DNA, 20 bp, mouse
gagagctgtccccttgtctt

SEQ ID NO: 854231 - DNA, 20 bp, mouse
gtgggtcacctgaagggcca

SEQ ID NO: 854232 - DNA, 20 bp, mouse
gtgggtcggcgtggaagggt

SEQ ID NO: 854233 - DNA, 20 bp, mouse
ggtcttgggtcggcgtggaa

SEQ ID NO: 854234 - DNA, 20 bp, mouse
gggcgggcccctggcccttc

SEQ ID NO: 854235 - DNA, 20 bp, mouse
gaatgagaagcgctcaaggt

SEQ ID NO: 854236 - DNA, 20 bp, mouse
gaaatgtagtccaatggctg

SEQ ID NO: 854237 - DNA, 20 bp, mouse
ggtcacgagagggttgtgtc

SEQ ID NO: 854238 - DNA, 20 bp, mouse
ggggtacttgcgtcacgaga

SEQ ID NO: 854239 - DNA, 20 bp, mouse
ggaaagaggagcggtttgga

SEQ ID NO: 854240 - DNA, 20 bp, mouse
gaacggcgttctgctcccgg

SEQ ID NO: 854241 - DNA, 20 bp, mouse
gggaggaaagaggagcggtt

SEQ ID NO: 854242 - DNA, 20 bp, mouse
gttgcgattggggggagaga

SEQ ID NO: 854243 - DNA, 20 bp, mouse
gtctcgccaggaaacggaaa

SEQ ID NO: 854244 - DNA, 20 bp, mouse
ggttctgctcccggtggctc

SEQ ID NO: 854245 - DNA, 20 bp, mouse
gagtaccccgaactctcgcc

SEQ ID NO: 854246 - DNA, 20 bp, mouse
gtgccggccgctctaggaag

SEQ ID NO: 854247 - DNA, 20 bp, mouse
gcccaccccaccatatcctg

SEQ ID NO: 854248 - DNA, 20 bp, mouse
gtagcagcccgcacttccgg

SEQ ID NO: 854249 - DNA, 20 bp, mouse
gtaacaggccttaaggtcct

SEQ ID NO: 854250 - DNA, 20 bp, mouse
gagagaccctctatggtccc

SEQ ID NO: 854251 - DNA, 20 bp, mouse
gcctcgcccgccggaagtgc

SEQ ID NO: 854252 - DNA, 20 bp, mouse
gggcagagccaaggacctta

SEQ ID NO: 854253 - DNA, 20 bp, mouse
gagaatccgcaggatatggt

SEQ ID NO: 854254 - DNA, 20 bp, mouse
ggaggcggagagaccctcta

SEQ ID NO: 854255 - DNA, 20 bp, mouse
gggtgggccggggaccatag

SEQ ID NO: 854256 - DNA, 20 bp, mouse
gggagcccgtagggtctcag

SEQ ID NO: 854257 - DNA, 20 bp, mouse
gtgagggtggcggtggtgtg

SEQ ID NO: 854258 - DNA, 20 bp, mouse
gccgttccccctcctcagat

SEQ ID NO: 854259 - DNA, 20 bp, mouse
ggaacgggctggagcccgta

SEQ ID NO: 854260 - DNA, 20 bp, mouse
gccgcaccgggctgtgtggc

SEQ ID NO: 854261 - DNA, 20 bp, mouse
gctcacaatgaacccatctg

SEQ ID NO: 854262 - DNA, 20 bp, mouse
gggcgtccggccacacagcc

SEQ ID NO: 854263 - DNA, 20 bp, mouse
gacaatgaacccatctgagg

SEQ ID NO: 854264 - DNA, 20 bp, mouse
gacaaaaatccggcaagggg

SEQ ID NO: 854265 - DNA, 20 bp, mouse
ggggctcgaaacggccgcag

SEQ ID NO: 854266 - DNA, 20 bp, mouse
gtcagggcggaggggctgta

SEQ ID NO: 854267 - DNA, 20 bp, mouse
ggaggccgacgctggtctcc

SEQ ID NO: 854268 - DNA, 20 bp, mouse
gcaggctgtgagccgggcaa

SEQ ID NO: 854269 - DNA, 20 bp, mouse
gccgcagtgtcagggcggag

SEQ ID NO: 854270 - DNA, 20 bp, mouse
ggctgtaagggcttcaccgc

SEQ ID NO: 854271 - DNA, 20 bp, mouse
gcaggcccgggagtctacct

SEQ ID NO: 854272 - DNA, 20 bp, mouse
ggctgtgagccgggcaacgg

SEQ ID NO: 854273 - DNA, 20 bp, mouse
gttgtcctggagaccagcgt

SEQ ID NO: 854274 - DNA, 20 bp, mouse
gggttctaagaatgcagcga

SEQ ID NO: 854275 - DNA, 20 bp, mouse
ggagaaactagaaatctgac

SEQ ID NO: 854276 - DNA, 20 bp, mouse
gcggaggtcgatgggaagag

SEQ ID NO: 854277 - DNA, 20 bp, mouse
gggggctcagaggatggcga

SEQ ID NO: 854278 - DNA, 20 bp, mouse
ggtacagtctgcggcccgaa

SEQ ID NO: 854279 - DNA, 20 bp, mouse
gagtggatgccttggaatga

SEQ ID NO: 854280 - DNA, 20 bp, mouse
gtcagatggaccattcccgg

SEQ ID NO: 854281 - DNA, 20 bp, mouse
ggtagagctcacgccggcgg

SEQ ID NO: 854282 - DNA, 20 bp, mouse
gctgaagaacagcctctccc

SEQ ID NO: 854283 - DNA, 20 bp, mouse
gaaggctgtagagctcacgc

SEQ ID NO: 854284 - DNA, 20 bp, mouse
ggctgtagagctcacgccgg

SEQ ID NO: 854285 - DNA, 20 bp, mouse
gaaaggaaggcctcccgcac

SEQ ID NO: 854286 - DNA, 20 bp, mouse
ggatggtaacacaaagtaga

SEQ ID NO: 854287 - DNA, 20 bp, mouse
gtggggtccgaaaccaaatg

SEQ ID NO: 854288 - DNA, 20 bp, mouse
gacacaaagtagaaggttga

SEQ ID NO: 854289 - DNA, 20 bp, mouse
gtgggtaatgcgaccccatt

SEQ ID NO: 854290 - DNA, 20 bp, mouse
gtggacttgcggtacaaagc

SEQ ID NO: 854291 - DNA, 20 bp, mouse
gtactgtttggagaggtacg

SEQ ID NO: 854292 - DNA, 20 bp, mouse
ggtttggagaggtacgtgga

SEQ ID NO: 854293 - DNA, 20 bp, mouse
gtgacttctactgtttggag

SEQ ID NO: 854294 - DNA, 20 bp, mouse
gcatagcttttctgcagaaa

SEQ ID NO: 854295 - DNA, 20 bp, mouse
gatgcgaccccatttggttt

SEQ ID NO: 854296 - DNA, 20 bp, mouse
gtacaagtaagtagaaaagg

SEQ ID NO: 854297 - DNA, 20 bp, mouse
gcagtgggtctgaaaatgag

SEQ ID NO: 854298 - DNA, 20 bp, mouse
gccataggccattgcaggaa

SEQ ID NO: 854299 - DNA, 20 bp, mouse
ggaattccataggccattgc

SEQ ID NO: 854300 - DNA, 20 bp, mouse
ggaagtagcactgagtgtca

SEQ ID NO: 854301 - DNA, 20 bp, mouse
gcactcctctttgcctcctg

SEQ ID NO: 854302 - DNA, 20 bp, mouse
gaagatgaagaagatggatg

SEQ ID NO: 854303 - DNA, 20 bp, mouse
gaatgagaaagaaagcacgc

SEQ ID NO: 854304 - DNA, 20 bp, mouse
ggtagtcacctttcctgcaa

SEQ ID NO: 854305 - DNA, 20 bp, mouse
gtctttgcctcctgaggtct

SEQ ID NO: 854306 - DNA, 20 bp, mouse
gccagaagcgagaaggtcgg

SEQ ID NO: 854307 - DNA, 20 bp, mouse
gttctcgcccggacttgggg

SEQ ID NO: 854308 - DNA, 20 bp, mouse
gagacagcgcaaaggaccat

SEQ ID NO: 854309 - DNA, 20 bp, mouse
ggcgtgcctgtgagcttcgc

SEQ ID NO: 854310 - DNA, 20 bp, mouse
gttaacaggtgaggggagga

SEQ ID NO: 854311 - DNA, 20 bp, mouse
gttagttaacaggtgagggg

SEQ ID NO: 854312 - DNA, 20 bp, mouse
ggcgtggcctagccggacgt

SEQ ID NO: 854313 - DNA, 20 bp, mouse
gcgggggtcgatagacagaa

SEQ ID NO: 854314 - DNA, 20 bp, mouse
gagccggaagggcgggtcta

SEQ ID NO: 854315 - DNA, 20 bp, mouse
ggccagcctgcgaagctcac

SEQ ID NO: 854316 - DNA, 20 bp, mouse
ggtcgtccccggacttagat

SEQ ID NO: 854317 - DNA, 20 bp, mouse
ggacccacaactccagcgtc

SEQ ID NO: 854318 - DNA, 20 bp, mouse
gatccagacgctggagttgt

SEQ ID NO: 854319 - DNA, 20 bp, mouse
ggttttcccatctaagtccg

SEQ ID NO: 854320 - DNA, 20 bp, mouse
ggtgcgcggaagggacagcg

SEQ ID NO: 854321 - DNA, 20 bp, mouse
gtgctaccttgttgcaaagt

SEQ ID NO: 854322 - DNA, 20 bp, mouse
ggggttgactggtaactgtt

SEQ ID NO: 854323 - DNA, 20 bp, mouse
gcagctccaactttgcaaca

SEQ ID NO: 854324 - DNA, 20 bp, mouse
gtacctgcttctcctctttg

SEQ ID NO: 854325 - DNA, 20 bp, mouse
gggcacaggcttctagtcag

SEQ ID NO: 854326 - DNA, 20 bp, mouse
gtacaggactcatcacagta

SEQ ID NO: 854327 - DNA, 20 bp, mouse
ggtagagagtgaggggacgt

SEQ ID NO: 854328 - DNA, 20 bp, mouse
gtcgggacgcacgagcgtac

SEQ ID NO: 854329 - DNA, 20 bp, mouse
gccggcggggtgtcttgtga

SEQ ID NO: 854330 - DNA, 20 bp, mouse
gtcctagtgtagagagtgag

SEQ ID NO: 854331 - DNA, 20 bp, mouse
gaagaaaacccgattcctat

SEQ ID NO: 854332 - DNA, 20 bp, mouse
gacgtgggggcggggaagta

SEQ ID NO: 854333 - DNA, 20 bp, mouse
ggagggataagaggaatctg

SEQ ID NO: 854334 - DNA, 20 bp, mouse
gtttgccagaagtcagccgg

SEQ ID NO: 854335 - DNA, 20 bp, mouse
gtgcgcctgtgtgagccaat

SEQ ID NO: 854336 - DNA, 20 bp, mouse
gaggcactggcttggcagta

SEQ ID NO: 854337 - DNA, 20 bp, mouse
gctcgcagagaggcccgcgg

SEQ ID NO: 854338 - DNA, 20 bp, mouse
gaaccctaatcctccgtcag

SEQ ID NO: 854339 - DNA, 20 bp, mouse
gctacctgggacttcctaga

SEQ ID NO: 854340 - DNA, 20 bp, mouse
ggctgagatggcattcctcc

SEQ ID NO: 854341 - DNA, 20 bp, mouse
gagaggcccgcggaggaagt

SEQ ID NO: 854342 - DNA, 20 bp, mouse
gggcttggcagtaaggctga

SEQ ID NO: 854343 - DNA, 20 bp, mouse
gtccaaatgtgaacctctga

SEQ ID NO: 854344 - DNA, 20 bp, mouse
gaggcgccagggaggcattt

SEQ ID NO: 854345 - DNA, 20 bp, mouse
gcgccagggaggcatttggg

SEQ ID NO: 854346 - DNA, 20 bp, mouse
gacagctagcgcacaactta

SEQ ID NO: 854347 - DNA, 20 bp, mouse
gcgggagcgctagctctgat

SEQ ID NO: 854348 - DNA, 20 bp, mouse
gccgtcctacgtgagtccta

SEQ ID NO: 854349 - DNA, 20 bp, mouse
gggtccccctgcctcggaga

SEQ ID NO: 854350 - DNA, 20 bp, mouse
ggggcgagaaaaactcagta

SEQ ID NO: 854351 - DNA, 20 bp, mouse
gttgctgcagagttccgggg

SEQ ID NO: 854352 - DNA, 20 bp, mouse
gcaggagtgggaaccccccc

SEQ ID NO: 854353 - DNA, 20 bp, mouse
gcagagctagcgctcccgga

SEQ ID NO: 854354 - DNA, 20 bp, mouse
ggtaggacggagccgactgt

SEQ ID NO: 854355 - DNA, 20 bp, mouse
ggcagccgtaggactcacgt

SEQ ID NO: 854356 - DNA, 20 bp, mouse
gcccacgtcagcatcctagt

SEQ ID NO: 854357 - DNA, 20 bp, mouse
gtggtcctaggggattgggt

SEQ ID NO: 854358 - DNA, 20 bp, mouse
gaagctataagaccggaaat

SEQ ID NO: 854359 - DNA, 20 bp, mouse
gtcgtcccacccaatcccct

SEQ ID NO: 854360 - DNA, 20 bp, mouse
gcccgagggaatcactgagt

SEQ ID NO: 854361 - DNA, 20 bp, mouse
gttacttgactcactactcg

SEQ ID NO: 854362 - DNA, 20 bp, mouse
gagggaatcactgagtgggt

SEQ ID NO: 854363 - DNA, 20 bp, mouse
gtcctagtgggctctaaaag

SEQ ID NO: 854364 - DNA, 20 bp, mouse
ggggctctaaaagcggcggg

SEQ ID NO: 854365 - DNA, 20 bp, mouse
ggaccataaagctataagac

SEQ ID NO: 854366 - DNA, 20 bp, mouse
gaccgcgtggcggggaaagg

SEQ ID NO: 854367 - DNA, 20 bp, mouse
ggcggcagcggaacgagaat

SEQ ID NO: 854368 - DNA, 20 bp, mouse
gacgaccgcgtggcggggaa

SEQ ID NO: 854369 - DNA, 20 bp, mouse
gcggcgctcatctgcatctc

SEQ ID NO: 854370 - DNA, 20 bp, mouse
ggggaaaggtggcgaggatc

SEQ ID NO: 854371 - DNA, 20 bp, mouse
gtgcatctccggaagatggc

SEQ ID NO: 854372 - DNA, 20 bp, mouse
gcatctgcatctccggaaga

SEQ ID NO: 854373 - DNA, 20 bp, mouse
gcggtcgtcagcctcgagac

SEQ ID NO: 854374 - DNA, 20 bp, mouse
ggcagatgagcgccgagctc

SEQ ID NO: 854375 - DNA, 20 bp, mouse
gccgccccgcgagggattct

SEQ ID NO: 854376 - DNA, 20 bp, mouse
gcctgcgcctagtcactttg

SEQ ID NO: 854377 - DNA, 20 bp, mouse
gcacttgtctgcccagcgat

SEQ ID NO: 854378 - DNA, 20 bp, mouse
gctacagcctctgttggagc

SEQ ID NO: 854379 - DNA, 20 bp, mouse
ggacaagtggtctagtcttg

SEQ ID NO: 854380 - DNA, 20 bp, mouse
gctgcagcagagagatttgt

SEQ ID NO: 854381 - DNA, 20 bp, mouse
gagcgcctaacgacagagaa

SEQ ID NO: 854382 - DNA, 20 bp, mouse
gcggtgcactagcctatcgc

SEQ ID NO: 854383 - DNA, 20 bp, mouse
gtagaccttgagtgcagtga

SEQ ID NO: 854384 - DNA, 20 bp, mouse
ggtgcaccgcagagccttct

SEQ ID NO: 854385 - DNA, 20 bp, mouse
gggtagcaggattaccggag

SEQ ID NO: 854386 - DNA, 20 bp, mouse
ggagtcgagcgctttaaagt

SEQ ID NO: 854387 - DNA, 20 bp, mouse
gaggtactatggtaggtact

SEQ ID NO: 854388 - DNA, 20 bp, mouse
gactctgcatgagacataca

SEQ ID NO: 854389 - DNA, 20 bp, mouse
gtatactatggtaggtacta

SEQ ID NO: 854390 - DNA, 20 bp, mouse
gaacgggcaaacatacccag

SEQ ID NO: 854391 - DNA, 20 bp, mouse
gccctgctcagattacactt

SEQ ID NO: 854392 - DNA, 20 bp, mouse
gatgcagagtgtaattgcaa

SEQ ID NO: 854393 - DNA, 20 bp, mouse
gatactgtggttagttggtc

SEQ ID NO: 854394 - DNA, 20 bp, mouse
gtttactattatactatggt

SEQ ID NO: 854395 - DNA, 20 bp, mouse
gtattaggatgtatatactg

SEQ ID NO: 854396 - DNA, 20 bp, mouse
gtccttgcaccttccactgt

SEQ ID NO: 854397 - DNA, 20 bp, mouse
gtgggtaatgcgattggttt

SEQ ID NO: 854398 - DNA, 20 bp, mouse
gcttatgtgcagaaatgcta

SEQ ID NO: 854399 - DNA, 20 bp, mouse
gcagaagggtatttcctaga

SEQ ID NO: 854400 - DNA, 20 bp, mouse
gagtagaagtcacctaacct

SEQ ID NO: 854401 - DNA, 20 bp, mouse
gatgctatgggtaatgcgat

SEQ ID NO: 854402 - DNA, 20 bp, mouse
gtcggatcccagaaccacaa

SEQ ID NO: 854403 - DNA, 20 bp, mouse
gtacagtaaccagcgtggga

SEQ ID NO: 854404 - DNA, 20 bp, mouse
ggcaatacagtaaccagcgt

SEQ ID NO: 854405 - DNA, 20 bp, mouse
gaaaaaaaaagttgacttag

SEQ ID NO: 854406 - DNA, 20 bp, mouse
gactgagagcagctgcacat

SEQ ID NO: 854407 - DNA, 20 bp, mouse
gtgtgaaaggctcatcttac

SEQ ID NO: 854408 - DNA, 20 bp, mouse
gtgggctcttttaaaatcct

SEQ ID NO: 854409 - DNA, 20 bp, mouse
gtgatgacgtcacaggcgat

SEQ ID NO: 854410 - DNA, 20 bp, mouse
gagagttcctgggatcacaa

SEQ ID NO: 854411 - DNA, 20 bp, mouse
gaaatcctgtaagtgcacaa

SEQ ID NO: 854412 - DNA, 20 bp, mouse
gaacatcaaacctaaggcaa

SEQ ID NO: 854413 - DNA, 20 bp, mouse
gcaggatttccctttgcctt

SEQ ID NO: 854414 - DNA, 20 bp, mouse
ggcagatgttttcttagtac

SEQ ID NO: 854415 - DNA, 20 bp, mouse
gcgagccattgtgcacttac

SEQ ID NO: 854416 - DNA, 20 bp, mouse
gcacttgctcacagtagggc

SEQ ID NO: 854417 - DNA, 20 bp, mouse
gaacccatttggagtgttcc

SEQ ID NO: 854418 - DNA, 20 bp, mouse
gaacagaagaacaggaaatc

SEQ ID NO: 854419 - DNA, 20 bp, mouse
gaattccacttgctcacagt

SEQ ID NO: 854420 - DNA, 20 bp, mouse
gctggtgatgtcataattgt

SEQ ID NO: 854421 - DNA, 20 bp, mouse
gcttccaggaacactccaaa

SEQ ID NO: 854422 - DNA, 20 bp, mouse
ggaagaacaggaaatcaggc

SEQ ID NO: 854423 - DNA, 20 bp, mouse
gcacagtagggcaggtaccc

SEQ ID NO: 854424 - DNA, 20 bp, mouse
gttcccacaagtcagtgcaa

SEQ ID NO: 854425 - DNA, 20 bp, mouse
gaattatgacatcaccagaa

SEQ ID NO: 854426 - DNA, 20 bp, mouse
ggactccccgtggttgtcat

SEQ ID NO: 854427 - DNA, 20 bp, mouse
gcaggggcagcttacagcat

SEQ ID NO: 854428 - DNA, 20 bp, mouse
gacctgcagtagagtgtgga

SEQ ID NO: 854429 - DNA, 20 bp, mouse
gcccctgcccgcctgcacag

SEQ ID NO: 854430 - DNA, 20 bp, mouse
gggaaacctgcagtagagtg

SEQ ID NO: 854431 - DNA, 20 bp, mouse
gaaaccatcctgactccccg

SEQ ID NO: 854432 - DNA, 20 bp, mouse
gtacgctcctagcttctcag

SEQ ID NO: 854433 - DNA, 20 bp, mouse
gacttcctggagtccaggta

SEQ ID NO: 854434 - DNA, 20 bp, mouse
gagccacaacaagaggtgta

SEQ ID NO: 854435 - DNA, 20 bp, mouse
gagttcctatgacaaccacg

SEQ ID NO: 854436 - DNA, 20 bp, mouse
gaggtagaagagattcattg

SEQ ID NO: 854437 - DNA, 20 bp, mouse
gacgggagacttctctgcct

SEQ ID NO: 854438 - DNA, 20 bp, mouse
gctgttgtctctgactgaac

SEQ ID NO: 854439 - DNA, 20 bp, mouse
gcatggccgggaatcttatt

SEQ ID NO: 854440 - DNA, 20 bp, mouse
gagaagagattcattgtggc

SEQ ID NO: 854441 - DNA, 20 bp, mouse
gctctgcctaggctgggaaa

SEQ ID NO: 854442 - DNA, 20 bp, mouse
ggagacttctctgcctaggc

SEQ ID NO: 854443 - DNA, 20 bp, mouse
gcacacacactgaaggactt

SEQ ID NO: 854444 - DNA, 20 bp, mouse
gtcagagacaacaggcgtct

SEQ ID NO: 854445 - DNA, 20 bp, mouse
ggggcatcaagccaaggttt

SEQ ID NO: 854446 - DNA, 20 bp, mouse
ggggacttggagtttcactc

SEQ ID NO: 854447 - DNA, 20 bp, mouse
ggggagggaaaagaacaaaa

SEQ ID NO: 854448 - DNA, 20 bp, mouse
gagcagccaagagcagggga

SEQ ID NO: 854449 - DNA, 20 bp, mouse
gtgaaactccaagtcccgtc

SEQ ID NO: 854450 - DNA, 20 bp, mouse
gcacgcgtgcgcgcacctcg

SEQ ID NO: 854451 - DNA, 20 bp, mouse
gggcctgggctgtcaaatga

SEQ ID NO: 854452 - DNA, 20 bp, mouse
gccggccagggagtctccca

SEQ ID NO: 854453 - DNA, 20 bp, mouse
gcacgcgtgatggagctacc

SEQ ID NO: 854454 - DNA, 20 bp, mouse
gacttagcagccaagagcag

SEQ ID NO: 854455 - DNA, 20 bp, mouse
gcagggagtctcccaaggga

SEQ ID NO: 854456 - DNA, 20 bp, mouse
gaaaacgccggagcaccagg

SEQ ID NO: 854457 - DNA, 20 bp, mouse
gacaacaacgtgcaggagaa

SEQ ID NO: 854458 - DNA, 20 bp, mouse
gggagagagacggatatctc

SEQ ID NO: 854459 - DNA, 20 bp, mouse
gcgcgctgaaccccagaagg

SEQ ID NO: 854460 - DNA, 20 bp, mouse
gctccggcgttttgtgtggc

SEQ ID NO: 854461 - DNA, 20 bp, mouse
gggtgctccggcgttttgtg

SEQ ID NO: 854462 - DNA, 20 bp, mouse
gctgaataatgagcaaccag

SEQ ID NO: 854463 - DNA, 20 bp, mouse
gcaaggtggttgcaaagtta

SEQ ID NO: 854464 - DNA, 20 bp, mouse
gtcccgcgctgaaccccaga

SEQ ID NO: 854465 - DNA, 20 bp, mouse
ggccagtgagatgtaagagg

SEQ ID NO: 854466 - DNA, 20 bp, mouse
gggcgctgatggggagatga

SEQ ID NO: 854467 - DNA, 20 bp, mouse
ggctcctcgcgcttctaggg

SEQ ID NO: 854468 - DNA, 20 bp, mouse
gatggctcctcgcgcttcta

SEQ ID NO: 854469 - DNA, 20 bp, mouse
gaggagatcctggcgctgat

SEQ ID NO: 854470 - DNA, 20 bp, mouse
gccaaataggtcaccaaaga

SEQ ID NO: 854471 - DNA, 20 bp, mouse
gaaagactgccaggagatcc

SEQ ID NO: 854472 - DNA, 20 bp, mouse
gcaagctaccacgtctagaa

SEQ ID NO: 854473 - DNA, 20 bp, mouse
gacgtggtagcttggagagg

SEQ ID NO: 854474 - DNA, 20 bp, mouse
gcttctagggagggttgctt

SEQ ID NO: 854475 - DNA, 20 bp, mouse
gtgctccgccctctcgtccc

SEQ ID NO: 854476 - DNA, 20 bp, mouse
gagaggagggggcgtgtttg

SEQ ID NO: 854477 - DNA, 20 bp, mouse
gggtcccgcgggagactgtc

SEQ ID NO: 854478 - DNA, 20 bp, mouse
gcgcgggagggtgcactaat

SEQ ID NO: 854479 - DNA, 20 bp, mouse
gcgcggcgctaccacttact

SEQ ID NO: 854480 - DNA, 20 bp, mouse
gcaccaggatccacccagac

SEQ ID NO: 854481 - DNA, 20 bp, mouse
ggggtgctcacagcctagga

SEQ ID NO: 854482 - DNA, 20 bp, mouse
gccagtggcagccgagtaag

SEQ ID NO: 854483 - DNA, 20 bp, mouse
ggggtgcaggtgacggtctg

SEQ ID NO: 854484 - DNA, 20 bp, mouse
gtggtagtagtgaagagttg

SEQ ID NO: 854485 - DNA, 20 bp, mouse
ggaaaggtggagcgcggaac

SEQ ID NO: 854486 - DNA, 20 bp, mouse
gaagaagcacggatagtgga

SEQ ID NO: 854487 - DNA, 20 bp, mouse
gaaaaggtatgagcttggac

SEQ ID NO: 854488 - DNA, 20 bp, mouse
gtgtacttacagacccattt

SEQ ID NO: 854489 - DNA, 20 bp, mouse
gcaacgcttaccaccgaaat

SEQ ID NO: 854490 - DNA, 20 bp, mouse
ggacctgtgtgtggtgtaga

SEQ ID NO: 854491 - DNA, 20 bp, mouse
gaactcagttctaaggagtt

SEQ ID NO: 854492 - DNA, 20 bp, mouse
gtacaccacacacaggtcca

SEQ ID NO: 854493 - DNA, 20 bp, mouse
gcggagaaaaggtatgagct

SEQ ID NO: 854494 - DNA, 20 bp, mouse
gtgaaatgtgataaccctcc

SEQ ID NO: 854495 - DNA, 20 bp, mouse
gaggggagtaacagtcaccc

SEQ ID NO: 854496 - DNA, 20 bp, mouse
gtccacgggtacctcgtcac

SEQ ID NO: 854497 - DNA, 20 bp, mouse
gcagcacagcagagtaccaa

SEQ ID NO: 854498 - DNA, 20 bp, mouse
gtgggcgccggggtttctca

SEQ ID NO: 854499 - DNA, 20 bp, mouse
gcggaggccgaccaaggctg

SEQ ID NO: 854500 - DNA, 20 bp, mouse
gccggatcggagtgagagtc

SEQ ID NO: 854501 - DNA, 20 bp, mouse
gcctccccggaagtttctgc

SEQ ID NO: 854502 - DNA, 20 bp, mouse
gccgaccaaggctggggttc

SEQ ID NO: 854503 - DNA, 20 bp, mouse
gttctgcggggcaactgtaa

SEQ ID NO: 854504 - DNA, 20 bp, mouse
gtccgggccgtgagaaaccc

SEQ ID NO: 854505 - DNA, 20 bp, mouse
gcaagctgatggtcatacgt

SEQ ID NO: 854506 - DNA, 20 bp, mouse
ggaagcagaagtagactgga

SEQ ID NO: 854507 - DNA, 20 bp, mouse
gtcctgggtgttcagaactt

SEQ ID NO: 854508 - DNA, 20 bp, mouse
gtggcaacccgtcaacagaa

SEQ ID NO: 854509 - DNA, 20 bp, mouse
gtgtccctagataaaaggat

SEQ ID NO: 854510 - DNA, 20 bp, mouse
ggggttgccaagatatatcc

SEQ ID NO: 854511 - DNA, 20 bp, mouse
gccctctgtccctagataaa

SEQ ID NO: 854512 - DNA, 20 bp, mouse
gctgttgcctggatatatct

SEQ ID NO: 854513 - DNA, 20 bp, mouse
gggtatagctgccgtgtaaa

SEQ ID NO: 854514 - DNA, 20 bp, mouse
gtccttgtcccttctgttga

SEQ ID NO: 854515 - DNA, 20 bp, mouse
gccttcaaaacaaggggcaa

SEQ ID NO: 854516 - DNA, 20 bp, mouse
gaaagtgagagcagcgatga

SEQ ID NO: 854517 - DNA, 20 bp, mouse
gggaccttcaagcccgtaga

SEQ ID NO: 854518 - DNA, 20 bp, mouse
gtccgaagccagagtcgagg

SEQ ID NO: 854519 - DNA, 20 bp, mouse
gcaggggtgaggaccctcta

SEQ ID NO: 854520 - DNA, 20 bp, mouse
gaagccagagtcgaggaggg

SEQ ID NO: 854521 - DNA, 20 bp, mouse
gcagtgcactccaacctcta

SEQ ID NO: 854522 - DNA, 20 bp, mouse
gtgctacagtctatggtctc

SEQ ID NO: 854523 - DNA, 20 bp, mouse
gcccggaggagccaggggtg

SEQ ID NO: 854524 - DNA, 20 bp, mouse
ggcaaagttgctacagtcta

SEQ ID NO: 854525 - DNA, 20 bp, mouse
ggcggggcctggaatcccgc

SEQ ID NO: 854526 - DNA, 20 bp, mouse
gaaatcccttagagtgtaag

SEQ ID NO: 854527 - DNA, 20 bp, mouse
gccttagagtgtaaggggtt

SEQ ID NO: 854528 - DNA, 20 bp, mouse
gagggctacacagagagggg

SEQ ID NO: 854529 - DNA, 20 bp, mouse
gtgtgtcctggtacaaccac

SEQ ID NO: 854530 - DNA, 20 bp, mouse
ggaaatgctgaattcagtac

SEQ ID NO: 854531 - DNA, 20 bp, mouse
gctaaatttaaaccgggcag

SEQ ID NO: 854532 - DNA, 20 bp, mouse
gggctccctgtggttgtacc

SEQ ID NO: 854533 - DNA, 20 bp, mouse
gacaaccacagggagccagt

SEQ ID NO: 854534 - DNA, 20 bp, mouse
gaagcagtcagtttgtgtcc

SEQ ID NO: 854535 - DNA, 20 bp, mouse
gtaaaatgctaaatttaaac

SEQ ID NO: 854536 - DNA, 20 bp, mouse
gagggaggggacaagccgag

SEQ ID NO: 854537 - DNA, 20 bp, mouse
gggagcccgaggtgattgga

SEQ ID NO: 854538 - DNA, 20 bp, mouse
ggtccgggtagcgaaatcga

SEQ ID NO: 854539 - DNA, 20 bp, mouse
ggaggggacaagccgagggg

SEQ ID NO: 854540 - DNA, 20 bp, mouse
ggggtagcgaaatcgaggga

SEQ ID NO: 854541 - DNA, 20 bp, mouse
gagccgaggggcggcgaaga

SEQ ID NO: 854542 - DNA, 20 bp, mouse
ggaggtgattggagggtcaa

SEQ ID NO: 854543 - DNA, 20 bp, mouse
ggggagtgttaacagacttc

SEQ ID NO: 854544 - DNA, 20 bp, mouse
gctccctcttcgccgcccct

SEQ ID NO: 854545 - DNA, 20 bp, mouse
gaatgggagcccgaggtgat

SEQ ID NO: 854546 - DNA, 20 bp, mouse
gggcgtgggcggggctgtgg

SEQ ID NO: 854547 - DNA, 20 bp, mouse
ggtcctgtcagagctggtgt

SEQ ID NO: 854548 - DNA, 20 bp, mouse
gaagaacgatggggtaaatg

SEQ ID NO: 854549 - DNA, 20 bp, mouse
gggagtgatggctggagcga

SEQ ID NO: 854550 - DNA, 20 bp, mouse
ggcctccaggctcacctgac

SEQ ID NO: 854551 - DNA, 20 bp, mouse
gagaaagggccttaaggctc

SEQ ID NO: 854552 - DNA, 20 bp, mouse
gggagcgatggctggagtga

SEQ ID NO: 854553 - DNA, 20 bp, mouse
gccacgccctctggcagaaa

SEQ ID NO: 854554 - DNA, 20 bp, mouse
ggcagatgctgtggccatcc

SEQ ID NO: 854555 - DNA, 20 bp, mouse
gggatgaagaatgccccagc

SEQ ID NO: 854556 - DNA, 20 bp, mouse
gtggaagtccaggaggtgtt

SEQ ID NO: 854557 - DNA, 20 bp, mouse
gtgcttgcaccctccgtttc

SEQ ID NO: 854558 - DNA, 20 bp, mouse
gtgggagggacgggtctccg

SEQ ID NO: 854559 - DNA, 20 bp, mouse
gccactcacccggaaacgga

SEQ ID NO: 854560 - DNA, 20 bp, mouse
gggctgggcgagctgacagc

SEQ ID NO: 854561 - DNA, 20 bp, mouse
gggtgagtggccctgccccg

SEQ ID NO: 854562 - DNA, 20 bp, mouse
gagggccactcacccggaaa

SEQ ID NO: 854563 - DNA, 20 bp, mouse
gctgctagctagaccagaag

SEQ ID NO: 854564 - DNA, 20 bp, mouse
ggctagaccagaagtggatc

SEQ ID NO: 854565 - DNA, 20 bp, mouse
gacggagggtgcaagcacat

SEQ ID NO: 854566 - DNA, 20 bp, mouse
ggacgcgcggaggtgagtca

SEQ ID NO: 854567 - DNA, 20 bp, mouse
gcccgtggagaggaaccctg

SEQ ID NO: 854568 - DNA, 20 bp, mouse
ggcccttcggccaccgtcgg

SEQ ID NO: 854569 - DNA, 20 bp, mouse
gcacgcggcgcgaatcggaa

SEQ ID NO: 854570 - DNA, 20 bp, mouse
ggcagaggcccaagagaatc

SEQ ID NO: 854571 - DNA, 20 bp, mouse
gggaactggtcggagaaggg

SEQ ID NO: 854572 - DNA, 20 bp, mouse
gcgggcgcgggatcgggtac

SEQ ID NO: 854573 - DNA, 20 bp, mouse
gctggagccgggcgcgggat

SEQ ID NO: 854574 - DNA, 20 bp, mouse
gggcctgctgcagtagagac

SEQ ID NO: 854575 - DNA, 20 bp, mouse
gcgtggagcgagacaagccc

SEQ ID NO: 854576 - DNA, 20 bp, mouse
gtactcccttgttgctatgg

SEQ ID NO: 854577 - DNA, 20 bp, mouse
gcccgcccccatagcaacaa

SEQ ID NO: 854578 - DNA, 20 bp, mouse
gggaggagtctgaatattta

SEQ ID NO: 854579 - DNA, 20 bp, mouse
gctcccggatgtggtctcag

SEQ ID NO: 854580 - DNA, 20 bp, mouse
ggaagtaggtgttcagaaca

SEQ ID NO: 854581 - DNA, 20 bp, mouse
ggtgcaaacgctagttcggg

SEQ ID NO: 854582 - DNA, 20 bp, mouse
gtacatctggatctctccag

SEQ ID NO: 854583 - DNA, 20 bp, mouse
gggtgtgcaaacgctagttc

SEQ ID NO: 854584 - DNA, 20 bp, mouse
ggcctttggggcgtgaaggt

SEQ ID NO: 854585 - DNA, 20 bp, mouse
gaaagaaagagatatctggg

SEQ ID NO: 854586 - DNA, 20 bp, mouse
gggcccgcaccggtgtatgg

SEQ ID NO: 854587 - DNA, 20 bp, mouse
gtacgcgtccagcttctgat

SEQ ID NO: 854588 - DNA, 20 bp, mouse
ggtaacccaaccagccaacc

SEQ ID NO: 854589 - DNA, 20 bp, mouse
gtcccgagcctctggagagg

SEQ ID NO: 854590 - DNA, 20 bp, mouse
gcgtccagcttctgattggt

SEQ ID NO: 854591 - DNA, 20 bp, mouse
ggaagcggaagcgggtacgg

SEQ ID NO: 854592 - DNA, 20 bp, mouse
gggtaccagctggtcttcgg

SEQ ID NO: 854593 - DNA, 20 bp, mouse
gtgaatgtggagcaggagct

SEQ ID NO: 854594 - DNA, 20 bp, mouse
ggctccatgaatggaagcgg

SEQ ID NO: 854595 - DNA, 20 bp, mouse
ggcgcagtcgcagcatgacc

SEQ ID NO: 854596 - DNA, 20 bp, mouse
ggcagcacgccacgcctcta

SEQ ID NO: 854597 - DNA, 20 bp, mouse
ggccccggggacaggcaggt

SEQ ID NO: 854598 - DNA, 20 bp, mouse
gagcccgcggcttgaggaat

SEQ ID NO: 854599 - DNA, 20 bp, mouse
gtgcaccgaggtcacctcga

SEQ ID NO: 854600 - DNA, 20 bp, mouse
ggcggcggccgcttgttgct

SEQ ID NO: 854601 - DNA, 20 bp, mouse
gcgtgggcggggcgctgaag

SEQ ID NO: 854602 - DNA, 20 bp, mouse
gcaccacctgcccgccctag

SEQ ID NO: 854603 - DNA, 20 bp, mouse
gggcgggcgccggagaagag

SEQ ID NO: 854604 - DNA, 20 bp, mouse
gcacccacctgcctgtcccc

SEQ ID NO: 854605 - DNA, 20 bp, mouse
ggcacgccacgcctctaggg

SEQ ID NO: 854606 - DNA, 20 bp, mouse
ggaaggggacccggcgtcca

SEQ ID NO: 854607 - DNA, 20 bp, mouse
gggcgccagcagggctcgga

SEQ ID NO: 854608 - DNA, 20 bp, mouse
ggggggcccaggcgccagca

SEQ ID NO: 854609 - DNA, 20 bp, mouse
ggggacgcgcgaggacgcgc

SEQ ID NO: 854610 - DNA, 20 bp, mouse
gcgcggggccggtgcgtccc

SEQ ID NO: 854611 - DNA, 20 bp, mouse
gcgcgcgcgcgacgcgcgga

SEQ ID NO: 854612 - DNA, 20 bp, mouse
gctgctcaggccgtggacgc

SEQ ID NO: 854613 - DNA, 20 bp, mouse
gagggcgcagctggcgcggt

SEQ ID NO: 854614 - DNA, 20 bp, mouse
gcccctctgcataaggtctc

SEQ ID NO: 854615 - DNA, 20 bp, mouse
gggaagcctcgggcctgctc

SEQ ID NO: 854616 - DNA, 20 bp, mouse
gcccgcggctggtgagtaga

SEQ ID NO: 854617 - DNA, 20 bp, mouse
gcggctggtgagtagacggg

SEQ ID NO: 854618 - DNA, 20 bp, mouse
gggccatggcgctgagtcca

SEQ ID NO: 854619 - DNA, 20 bp, mouse
gctactgcggggggaagaac

SEQ ID NO: 854620 - DNA, 20 bp, mouse
gcgcggggatcctactgcgg

SEQ ID NO: 854621 - DNA, 20 bp, mouse
ggcacctgaggcgagcggaa

SEQ ID NO: 854622 - DNA, 20 bp, mouse
gtagacggggggcggtgagg

SEQ ID NO: 854623 - DNA, 20 bp, mouse
gctggtgagtagacgggggg

SEQ ID NO: 854624 - DNA, 20 bp, mouse
gggaggaggtcgtgtcgcgg

SEQ ID NO: 854625 - DNA, 20 bp, mouse
gagccgcggggatcctactg

SEQ ID NO: 854626 - DNA, 20 bp, mouse
ggcagagtgtgcaggacgga

SEQ ID NO: 854627 - DNA, 20 bp, mouse
gggctgtgggctctgagctt

SEQ ID NO: 854628 - DNA, 20 bp, mouse
gcctccttgggtcctgcgga

SEQ ID NO: 854629 - DNA, 20 bp, mouse
ggggggcgatcgcacccact

SEQ ID NO: 854630 - DNA, 20 bp, mouse
ggcagtgaaggggcaacctc

SEQ ID NO: 854631 - DNA, 20 bp, mouse
gtgtaggtccctacccgggg

SEQ ID NO: 854632 - DNA, 20 bp, mouse
ggcgccctagtgaaggagat

SEQ ID NO: 854633 - DNA, 20 bp, mouse
gcaatgcggcgcgactgcag

SEQ ID NO: 854634 - DNA, 20 bp, mouse
gcgactccgcccccccgggt

SEQ ID NO: 854635 - DNA, 20 bp, mouse
gcgcgactgcagcggagagg

SEQ ID NO: 854636 - DNA, 20 bp, mouse
gagactggctgcaagagtgt

SEQ ID NO: 854637 - DNA, 20 bp, mouse
gctgtgcagagcaacctgaa

SEQ ID NO: 854638 - DNA, 20 bp, mouse
ggggcccgcccagcggagac

SEQ ID NO: 854639 - DNA, 20 bp, mouse
ggtcctaccagatatagttc

SEQ ID NO: 854640 - DNA, 20 bp, mouse
ggtagaggaagggtgtagtg

SEQ ID NO: 854641 - DNA, 20 bp, mouse
gaaatagaggatggaagatg

SEQ ID NO: 854642 - DNA, 20 bp, mouse
gggaagggtgtagtgtgggt

SEQ ID NO: 854643 - DNA, 20 bp, mouse
gctcgcccagaaatagagga

SEQ ID NO: 854644 - DNA, 20 bp, mouse
ggagaggatgatagtgagat

SEQ ID NO: 854645 - DNA, 20 bp, mouse
ggggaggggccggtctccgc

SEQ ID NO: 854646 - DNA, 20 bp, mouse
ggtcccgccaagacccggac

SEQ ID NO: 854647 - DNA, 20 bp, mouse
gtctgcggccggcgaggctc

SEQ ID NO: 854648 - DNA, 20 bp, mouse
gagggggtcccgccaagacc

SEQ ID NO: 854649 - DNA, 20 bp, mouse
gggagggcaggcgggcgcga

SEQ ID NO: 854650 - DNA, 20 bp, mouse
gccgccaagacccggactgg

SEQ ID NO: 854651 - DNA, 20 bp, mouse
gcgcgcgggggtggcagcgc

SEQ ID NO: 854652 - DNA, 20 bp, mouse
ggcgggatccggagcctcgc

SEQ ID NO: 854653 - DNA, 20 bp, mouse
ggggcgcgcgcaccggcggg

SEQ ID NO: 854654 - DNA, 20 bp, mouse
gggcggggcgcgcgcaccgg

SEQ ID NO: 854655 - DNA, 20 bp, mouse
gacagaggggcatgattaaa

SEQ ID NO: 854656 - DNA, 20 bp, mouse
gggaggggatgggactccga

SEQ ID NO: 854657 - DNA, 20 bp, mouse
ggagcggcggtgggctgctc

SEQ ID NO: 854658 - DNA, 20 bp, mouse
gcggcggtgggctgctcggg

SEQ ID NO: 854659 - DNA, 20 bp, mouse
gggaaaaaatcgagcggcgg

SEQ ID NO: 854660 - DNA, 20 bp, mouse
gcgggagagaagcgtccctt

SEQ ID NO: 854661 - DNA, 20 bp, mouse
gctcgcctgaggagactcgg

SEQ ID NO: 854662 - DNA, 20 bp, mouse
ggcggtcgccatagcaacgg

SEQ ID NO: 854663 - DNA, 20 bp, mouse
gccttggggcgccgttgcac

SEQ ID NO: 854664 - DNA, 20 bp, mouse
gtctgtcagaaggtgaactg

SEQ ID NO: 854665 - DNA, 20 bp, mouse
gctggcgaggccgcgtcacc

SEQ ID NO: 854666 - DNA, 20 bp, mouse
ggcgcccgcggggaacaaag

SEQ ID NO: 854667 - DNA, 20 bp, mouse
ggggcccagcccctaggcgg

SEQ ID NO: 854668 - DNA, 20 bp, mouse
gacgggccgaagcgtgggaa

SEQ ID NO: 854669 - DNA, 20 bp, mouse
ggtaccggatagatgagaag

SEQ ID NO: 854670 - DNA, 20 bp, mouse
gtgagctggaccccgcccct

SEQ ID NO: 854671 - DNA, 20 bp, mouse
gggaacaaagaggatgccct

SEQ ID NO: 854672 - DNA, 20 bp, mouse
gtgtcggggccttgggaccc

SEQ ID NO: 854673 - DNA, 20 bp, mouse
gccctcggcacggaagccgg

SEQ ID NO: 854674 - DNA, 20 bp, mouse
gtccctgctgccagcgcccg

SEQ ID NO: 854675 - DNA, 20 bp, mouse
gcgggttgggaaggcttcgt

SEQ ID NO: 854676 - DNA, 20 bp, mouse
gcgcctgcgtgttgggagtc

SEQ ID NO: 854677 - DNA, 20 bp, mouse
ggtcccggacaccgcctcca

SEQ ID NO: 854678 - DNA, 20 bp, mouse
ggcgcctgcgcagttctccg

SEQ ID NO: 854679 - DNA, 20 bp, mouse
gtgggcggtgctctcaggag

SEQ ID NO: 854680 - DNA, 20 bp, mouse
gtcccaacacgcaggcgcga

SEQ ID NO: 854681 - DNA, 20 bp, mouse
gtgccctggaggcggtgtcc

SEQ ID NO: 854682 - DNA, 20 bp, mouse
gcggtgtccgggaccaggag

SEQ ID NO: 854683 - DNA, 20 bp, mouse
gaatcagagctggtagcgca

SEQ ID NO: 854684 - DNA, 20 bp, mouse
ggcgtgttgggagtcaggcg

SEQ ID NO: 854685 - DNA, 20 bp, mouse
gcctgagagcaccgcccaat

SEQ ID NO: 854686 - DNA, 20 bp, mouse
gaggaagcctgagaccgagt

SEQ ID NO: 854687 - DNA, 20 bp, mouse
gtcacccggaagcagaggat

SEQ ID NO: 854688 - DNA, 20 bp, mouse
gttacagctggatctgtggg

SEQ ID NO: 854689 - DNA, 20 bp, mouse
gtgggagggactgatttccg

SEQ ID NO: 854690 - DNA, 20 bp, mouse
ggggaagaccgtgcagatca

SEQ ID NO: 854691 - DNA, 20 bp, mouse
ggccactcacccggaagcag

SEQ ID NO: 854692 - DNA, 20 bp, mouse
gatgggaggatgttacacat

SEQ ID NO: 854693 - DNA, 20 bp, mouse
gaggctcgcaacaagcaggt

SEQ ID NO: 854694 - DNA, 20 bp, mouse
gcccggaagcagaggatggg

SEQ ID NO: 854695 - DNA, 20 bp, mouse
gaggatgttacacattggct

SEQ ID NO: 854696 - DNA, 20 bp, mouse
ggcgttaggggacaagtcaa

SEQ ID NO: 854697 - DNA, 20 bp, mouse
gacaagtcaagggacagtaa

SEQ ID NO: 854698 - DNA, 20 bp, mouse
ggggacagtaagggaagagg

SEQ ID NO: 854699 - DNA, 20 bp, mouse
ggtggtggtggtgacagggc

SEQ ID NO: 854700 - DNA, 20 bp, mouse
gtcaccagtgtgctacccag

SEQ ID NO: 854701 - DNA, 20 bp, mouse
gaggtgcttgaaagaagaga

SEQ ID NO: 854702 - DNA, 20 bp, mouse
ggacccgcggggtggcacga

SEQ ID NO: 854703 - DNA, 20 bp, mouse
gcagccagcgccttgagggg

SEQ ID NO: 854704 - DNA, 20 bp, mouse
gtccaaaatcccttcacctc

SEQ ID NO: 854705 - DNA, 20 bp, mouse
gggccccaccagctccagtg

SEQ ID NO: 854706 - DNA, 20 bp, mouse
gtcaccctccaacacgaccc

SEQ ID NO: 854707 - DNA, 20 bp, mouse
gccctcctgggtcgtgttgg

SEQ ID NO: 854708 - DNA, 20 bp, mouse
gagagaaagaagaggggcgt

SEQ ID NO: 854709 - DNA, 20 bp, mouse
ggaaagaagaggggcgtggg

SEQ ID NO: 854710 - DNA, 20 bp, mouse
ggtcccctcctgggtcgtgt

SEQ ID NO: 854711 - DNA, 20 bp, mouse
gctggcgaccctccgtgcgt

SEQ ID NO: 854712 - DNA, 20 bp, mouse
gctacgccaggtcccgccgc

SEQ ID NO: 854713 - DNA, 20 bp, mouse
gcgcggggatgcccaactcg

SEQ ID NO: 854714 - DNA, 20 bp, mouse
gccagcttcgctcactgctt

SEQ ID NO: 854715 - DNA, 20 bp, mouse
ggaacaaagatgtgagtgat

SEQ ID NO: 854716 - DNA, 20 bp, mouse
gctcccgcgcctgccattag

SEQ ID NO: 854717 - DNA, 20 bp, mouse
ggggtccagaataatcatcg

SEQ ID NO: 854718 - DNA, 20 bp, mouse
gcccaccgcgatgattattc

SEQ ID NO: 854719 - DNA, 20 bp, mouse
ggatccgcgctgtaaccttg

SEQ ID NO: 854720 - DNA, 20 bp, mouse
ggcggcgattggcaacataa

SEQ ID NO: 854721 - DNA, 20 bp, mouse
gtcgcctctaatggcaggcg

SEQ ID NO: 854722 - DNA, 20 bp, mouse
gtaaagtcgcctctaatggc

SEQ ID NO: 854723 - DNA, 20 bp, mouse
gtgattattctggacccata

SEQ ID NO: 854724 - DNA, 20 bp, mouse
gaaagtgggcatttcagtga

SEQ ID NO: 854725 - DNA, 20 bp, mouse
gtaaataaagtcgcctctaa

SEQ ID NO: 854726 - DNA, 20 bp, mouse
ggtggggagtctgtggagag

SEQ ID NO: 854727 - DNA, 20 bp, mouse
ggtccctccctatcagtctc

SEQ ID NO: 854728 - DNA, 20 bp, mouse
gacgctgacagcaaacttgt

SEQ ID NO: 854729 - DNA, 20 bp, mouse
gtgtcagcgtagactagaac

SEQ ID NO: 854730 - DNA, 20 bp, mouse
ggggagggacctgtctccgg

SEQ ID NO: 854731 - DNA, 20 bp, mouse
gccgcagcctgagactgata

SEQ ID NO: 854732 - DNA, 20 bp, mouse
ggccgttggggacagtatat

SEQ ID NO: 854733 - DNA, 20 bp, mouse
gagcctgagactgataggga

SEQ ID NO: 854734 - DNA, 20 bp, mouse
ggtagtcaagtcgaggtgta

SEQ ID NO: 854735 - DNA, 20 bp, mouse
gaagggttcagaactcagta

SEQ ID NO: 854736 - DNA, 20 bp, mouse
ggtcgtgcagcaaggttaaa

SEQ ID NO: 854737 - DNA, 20 bp, mouse
gtaaccttgctgcacgacct

SEQ ID NO: 854738 - DNA, 20 bp, mouse
ggaaaatggagccactgaga

SEQ ID NO: 854739 - DNA, 20 bp, mouse
gcatccccaggcttaaactt

SEQ ID NO: 854740 - DNA, 20 bp, mouse
gcaaagccgtgtccagagtc

SEQ ID NO: 854741 - DNA, 20 bp, mouse
gggaagggaagagccctcgc

SEQ ID NO: 854742 - DNA, 20 bp, mouse
gaggacgtattagaatcaag

SEQ ID NO: 854743 - DNA, 20 bp, mouse
gacgtattagaatcaagagg

SEQ ID NO: 854744 - DNA, 20 bp, mouse
ggctttgcttgtctggagac

SEQ ID NO: 854745 - DNA, 20 bp, mouse
gaataccactgcacaaaggg

SEQ ID NO: 854746 - DNA, 20 bp, mouse
gctagtgcgcggttcgtgtc

SEQ ID NO: 854747 - DNA, 20 bp, mouse
ggcaatacgcgagacgatgg

SEQ ID NO: 854748 - DNA, 20 bp, mouse
ggtacctgcctggggagcga

SEQ ID NO: 854749 - DNA, 20 bp, mouse
ggcgaggtgggcagttctta

SEQ ID NO: 854750 - DNA, 20 bp, mouse
gatgccccgagccaggccta

SEQ ID NO: 854751 - DNA, 20 bp, mouse
gggcctggctcggggcatgt

SEQ ID NO: 854752 - DNA, 20 bp, mouse
ggtctcgcgtattgcatccc

SEQ ID NO: 854753 - DNA, 20 bp, mouse
ggatgcaatacgcgagacga

SEQ ID NO: 854754 - DNA, 20 bp, mouse
gggcatgtgggcggagtcgc

SEQ ID NO: 854755 - DNA, 20 bp, mouse
gcctcgccgagcttccagtt

SEQ ID NO: 854756 - DNA, 20 bp, mouse
gccagcggcgcccgggacgt

SEQ ID NO: 854757 - DNA, 20 bp, mouse
gaaagcccagctcggagtgg

SEQ ID NO: 854758 - DNA, 20 bp, mouse
gccgcgcgggacaaccagga

SEQ ID NO: 854759 - DNA, 20 bp, mouse
gcgtgccagctgtccatccg

SEQ ID NO: 854760 - DNA, 20 bp, mouse
gagagacgatgctcggggac

SEQ ID NO: 854761 - DNA, 20 bp, mouse
gtggaatcaggggccctaag

SEQ ID NO: 854762 - DNA, 20 bp, mouse
gtcggcgagagacgatgctc

SEQ ID NO: 854763 - DNA, 20 bp, mouse
gcgctagcggcgtgcctcct

SEQ ID NO: 854764 - DNA, 20 bp, mouse
gacagctggcacggcggagc

SEQ ID NO: 854765 - DNA, 20 bp, mouse
gctgcccgcgcgggacaacc

SEQ ID NO: 854766 - DNA, 20 bp, mouse
gttggggtgggcgtcttcgg

SEQ ID NO: 854767 - DNA, 20 bp, mouse
gagtgaacggagttgacaag

SEQ ID NO: 854768 - DNA, 20 bp, mouse
gagggcagattacacgtctg

SEQ ID NO: 854769 - DNA, 20 bp, mouse
gggagtcagcgcagcggatg

SEQ ID NO: 854770 - DNA, 20 bp, mouse
gaagaacacgtacaatacga

SEQ ID NO: 854771 - DNA, 20 bp, mouse
gagggccggaagtggaagcg

SEQ ID NO: 854772 - DNA, 20 bp, mouse
gaagcgcggggcggaactga

SEQ ID NO: 854773 - DNA, 20 bp, mouse
gcctgggaactgtaagagga

SEQ ID NO: 854774 - DNA, 20 bp, mouse
gtgggcggaagtgaacctcg

SEQ ID NO: 854775 - DNA, 20 bp, mouse
gcggaagtggaagcgcgggg

SEQ ID NO: 854776 - DNA, 20 bp, mouse
gaaacagcccgcgcagtggt

SEQ ID NO: 854777 - DNA, 20 bp, mouse
gcgtaagagactgcggaggg

SEQ ID NO: 854778 - DNA, 20 bp, mouse
gggagcgtaagagactgcgg

SEQ ID NO: 854779 - DNA, 20 bp, mouse
gcccgcgcagtggtcggaac

SEQ ID NO: 854780 - DNA, 20 bp, mouse
gaggaagtgcagccgccgag

SEQ ID NO: 854781 - DNA, 20 bp, mouse
ggcacttccgctcccggcct

SEQ ID NO: 854782 - DNA, 20 bp, mouse
ggagctcgcgccggaagagt

SEQ ID NO: 854783 - DNA, 20 bp, mouse
gtggtcctgcagccccaggc

SEQ ID NO: 854784 - DNA, 20 bp, mouse
gtcttccggcgcgagctcta

SEQ ID NO: 854785 - DNA, 20 bp, mouse
gcgggcacaactccagtcgt

SEQ ID NO: 854786 - DNA, 20 bp, mouse
gcagccggttggtataaaag

SEQ ID NO: 854787 - DNA, 20 bp, mouse
gaccacaagaactaaatggc

SEQ ID NO: 854788 - DNA, 20 bp, mouse
gcttgaccacaagaactaaa

SEQ ID NO: 854789 - DNA, 20 bp, mouse
gaaccggctgattgatattg

SEQ ID NO: 854790 - DNA, 20 bp, mouse
gtcaagaagaaacaggcccc

SEQ ID NO: 854791 - DNA, 20 bp, mouse
gagctagaagccttggaagc

SEQ ID NO: 854792 - DNA, 20 bp, mouse
ggaactccaaagcccttggg

SEQ ID NO: 854793 - DNA, 20 bp, mouse
ggcaaaacaacgataggtta

SEQ ID NO: 854794 - DNA, 20 bp, mouse
gtctgtttcctgcaatcaaa

SEQ ID NO: 854795 - DNA, 20 bp, mouse
ggggctttggagttcccttc

SEQ ID NO: 854796 - DNA, 20 bp, mouse
ggagagctttggctgcaata

SEQ ID NO: 854797 - DNA, 20 bp, mouse
ggcccgggccatgagagctt

SEQ ID NO: 854798 - DNA, 20 bp, mouse
gaaagagtggatttctgccc

SEQ ID NO: 854799 - DNA, 20 bp, mouse
gtccccctggaaactaagtc

SEQ ID NO: 854800 - DNA, 20 bp, mouse
ggaagcgccgattggtgaag

SEQ ID NO: 854801 - DNA, 20 bp, mouse
gactccagacttagtttcca

SEQ ID NO: 854802 - DNA, 20 bp, mouse
gaccaatcggcgcttctgat

SEQ ID NO: 854803 - DNA, 20 bp, mouse
gtgtgctccgtggtactaat

SEQ ID NO: 854804 - DNA, 20 bp, mouse
gaaactcttaatttaataag

SEQ ID NO: 854805 - DNA, 20 bp, mouse
gcacacacattagagcttgg

SEQ ID NO: 854806 - DNA, 20 bp, mouse
gcctcagtgtggtggacgag

SEQ ID NO: 854807 - DNA, 20 bp, mouse
ggggaacgcggcagacaaga

SEQ ID NO: 854808 - DNA, 20 bp, mouse
ggggaaatgtagtcagtccg

SEQ ID NO: 854809 - DNA, 20 bp, mouse
ggggctccctggcttctcgc

SEQ ID NO: 854810 - DNA, 20 bp, mouse
gtagtcagtccgagggaacg

SEQ ID NO: 854811 - DNA, 20 bp, mouse
gaaggggcggagaactggta

SEQ ID NO: 854812 - DNA, 20 bp, mouse
gatagactgcatcaggaaag

SEQ ID NO: 854813 - DNA, 20 bp, mouse
ggagaagccagggagccctc

SEQ ID NO: 854814 - DNA, 20 bp, mouse
gcagtagtggaagctgatat

SEQ ID NO: 854815 - DNA, 20 bp, mouse
gcaagatggctcccgatggg

SEQ ID NO: 854816 - DNA, 20 bp, mouse
ggccgccggcgaagcagcgc

SEQ ID NO: 854817 - DNA, 20 bp, mouse
gggacaggagtcatggccga

SEQ ID NO: 854818 - DNA, 20 bp, mouse
gacaaccagaggaggcgctg

SEQ ID NO: 854819 - DNA, 20 bp, mouse
gacgtccagcgctgcttcgc

SEQ ID NO: 854820 - DNA, 20 bp, mouse
gctggacgtgagcagctgcg

SEQ ID NO: 854821 - DNA, 20 bp, mouse
gctgcggggacggtcttttc

SEQ ID NO: 854822 - DNA, 20 bp, mouse
gacgtgagcagctgcgggga

SEQ ID NO: 854823 - DNA, 20 bp, mouse
gccaacttccggtcagagct

SEQ ID NO: 854824 - DNA, 20 bp, mouse
gctaggtggctgtccctttg

SEQ ID NO: 854825 - DNA, 20 bp, mouse
gtccagcgctgcttcgccgg

SEQ ID NO: 854826 - DNA, 20 bp, mouse
gtaggcgggacgagaaggcg

SEQ ID NO: 854827 - DNA, 20 bp, mouse
gaacagtaggcgggacgaga

SEQ ID NO: 854828 - DNA, 20 bp, mouse
ggtaccaaacgaagagtgtg

SEQ ID NO: 854829 - DNA, 20 bp, mouse
gagtatttactcctggggtg

SEQ ID NO: 854830 - DNA, 20 bp, mouse
gacgagaaggcgtggcattc

SEQ ID NO: 854831 - DNA, 20 bp, mouse
gtgtggggttccctggttac

SEQ ID NO: 854832 - DNA, 20 bp, mouse
ggaaccccacactcttcgtt

SEQ ID NO: 854833 - DNA, 20 bp, mouse
ggtgaagaccaacagtaggc

SEQ ID NO: 854834 - DNA, 20 bp, mouse
gtgtgtagcccaggcaggcg

SEQ ID NO: 854835 - DNA, 20 bp, mouse
gtgcctagtacaaggaatta

SEQ ID NO: 854836 - DNA, 20 bp, mouse
gaccaatagagcggaggggt

SEQ ID NO: 854837 - DNA, 20 bp, mouse
ggggcagacagccgatgatt

SEQ ID NO: 854838 - DNA, 20 bp, mouse
gccctccgctctattggtcg

SEQ ID NO: 854839 - DNA, 20 bp, mouse
ggcacaattcgcccaatcat

SEQ ID NO: 854840 - DNA, 20 bp, mouse
gagcgagggaacattgctaa

SEQ ID NO: 854841 - DNA, 20 bp, mouse
gcctggaggccgaccagcga

SEQ ID NO: 854842 - DNA, 20 bp, mouse
gcatcgattggtctaatgac

SEQ ID NO: 854843 - DNA, 20 bp, mouse
gtggggtgagagcgaggctg

SEQ ID NO: 854844 - DNA, 20 bp, mouse
gaaaggcggaatccgagaag

SEQ ID NO: 854845 - DNA, 20 bp, mouse
ggaagcctcgaccaatagag

SEQ ID NO: 854846 - DNA, 20 bp, mouse
ggccccctccagccccggat

SEQ ID NO: 854847 - DNA, 20 bp, mouse
gaggaaagtgcacatctgta

SEQ ID NO: 854848 - DNA, 20 bp, mouse
gcctagctaggatccttagg

SEQ ID NO: 854849 - DNA, 20 bp, mouse
gctacttgagaccctatcac

SEQ ID NO: 854850 - DNA, 20 bp, mouse
gcccctctgcagcctcttgc

SEQ ID NO: 854851 - DNA, 20 bp, mouse
gcgcactctcggccagcaag

SEQ ID NO: 854852 - DNA, 20 bp, mouse
gccggggctggagggggcgt

SEQ ID NO: 854853 - DNA, 20 bp, mouse
gcctcccatccggggctgga

SEQ ID NO: 854854 - DNA, 20 bp, mouse
gtttcctagctaggatcctt

SEQ ID NO: 854855 - DNA, 20 bp, mouse
gaacaaaaagaaaccggagt

SEQ ID NO: 854856 - DNA, 20 bp, mouse
gaaacccggtgcttggtcgg

SEQ ID NO: 854857 - DNA, 20 bp, mouse
gctggatcccgggaggggaa

SEQ ID NO: 854858 - DNA, 20 bp, mouse
gcggaaacccggtgcttggt

SEQ ID NO: 854859 - DNA, 20 bp, mouse
gcaagcaccgggtttccggg

SEQ ID NO: 854860 - DNA, 20 bp, mouse
ggtccctggccctccgcttc

SEQ ID NO: 854861 - DNA, 20 bp, mouse
gaagccggaagcggagggcc

SEQ ID NO: 854862 - DNA, 20 bp, mouse
gctgagaagccggaagcgga

SEQ ID NO: 854863 - DNA, 20 bp, mouse
gcggctcctggatcccggga

SEQ ID NO: 854864 - DNA, 20 bp, mouse
gacagtgcctggcaccggca

SEQ ID NO: 854865 - DNA, 20 bp, mouse
gctgtcctttggaccctcag

SEQ ID NO: 854866 - DNA, 20 bp, mouse
gcgtgctagaacatccgttg

SEQ ID NO: 854867 - DNA, 20 bp, mouse
gaaaggagaggtgtcagcac

SEQ ID NO: 854868 - DNA, 20 bp, mouse
gccctactgacagcggagga

SEQ ID NO: 854869 - DNA, 20 bp, mouse
ggctgcttgtgacgtcacag

SEQ ID NO: 854870 - DNA, 20 bp, mouse
gcatccgttgaggctttgat

SEQ ID NO: 854871 - DNA, 20 bp, mouse
gaaaagttccggttgtaaaa

SEQ ID NO: 854872 - DNA, 20 bp, mouse
gcaggctgctttaaaagttc

SEQ ID NO: 854873 - DNA, 20 bp, mouse
gccgttgaggctttgatagg

SEQ ID NO: 854874 - DNA, 20 bp, mouse
gaggggttattagttgtatc

SEQ ID NO: 854875 - DNA, 20 bp, mouse
gagcacgtccgttttacaac

SEQ ID NO: 854876 - DNA, 20 bp, mouse
gttctctcatacactcctgt

SEQ ID NO: 854877 - DNA, 20 bp, mouse
gaacagccctagctgatttc

SEQ ID NO: 854878 - DNA, 20 bp, mouse
gtgacagccattgggaagtc

SEQ ID NO: 854879 - DNA, 20 bp, mouse
gacgaagcaatcactagtgt

SEQ ID NO: 854880 - DNA, 20 bp, mouse
gaatggctgtcaagcatagt

SEQ ID NO: 854881 - DNA, 20 bp, mouse
gaatcagctagggctgttcc

SEQ ID NO: 854882 - DNA, 20 bp, mouse
gaaaatcacaacacatggac

SEQ ID NO: 854883 - DNA, 20 bp, mouse
gcacaacacatggacaggaa

SEQ ID NO: 854884 - DNA, 20 bp, mouse
gggtccctgtgacgacacag

SEQ ID NO: 854885 - DNA, 20 bp, mouse
gatttcccggaaatcagcta

SEQ ID NO: 854886 - DNA, 20 bp, mouse
gctggagtctgcagctgtaa

SEQ ID NO: 854887 - DNA, 20 bp, mouse
gaagggagagcgcaaggggt

SEQ ID NO: 854888 - DNA, 20 bp, mouse
gtggcgcttggccaacgaga

SEQ ID NO: 854889 - DNA, 20 bp, mouse
gtacgggtcactcaaagcaa

SEQ ID NO: 854890 - DNA, 20 bp, mouse
gttgcctaagcggaaagggg

SEQ ID NO: 854891 - DNA, 20 bp, mouse
gacgcccgctacacacacga

SEQ ID NO: 854892 - DNA, 20 bp, mouse
gtacggggaaacagagactg

SEQ ID NO: 854893 - DNA, 20 bp, mouse
gaaaaccagcgggttagaga

SEQ ID NO: 854894 - DNA, 20 bp, mouse
gtccgcttaggcaaaaccag

SEQ ID NO: 854895 - DNA, 20 bp, mouse
ggctgtaaagggagagcgca

SEQ ID NO: 854896 - DNA, 20 bp, mouse
gctggttctgacgaccggaa

SEQ ID NO: 854897 - DNA, 20 bp, mouse
gctcttagacgaggagtcgg

SEQ ID NO: 854898 - DNA, 20 bp, mouse
ggagttctggttctgacgac

SEQ ID NO: 854899 - DNA, 20 bp, mouse
gaattctgtctcttcccttc

SEQ ID NO: 854900 - DNA, 20 bp, mouse
ggcgccggtagagctcacaa

SEQ ID NO: 854901 - DNA, 20 bp, mouse
ggaaagaaacccagcaacgt

SEQ ID NO: 854902 - DNA, 20 bp, mouse
gccgcgcaagggcctctggg

SEQ ID NO: 854903 - DNA, 20 bp, mouse
gggtgccctgtccagagcag

SEQ ID NO: 854904 - DNA, 20 bp, mouse
gaatgatgcgtgaaaaggta

SEQ ID NO: 854905 - DNA, 20 bp, mouse
ggagcggcgtaaggcatgct

SEQ ID NO: 854906 - DNA, 20 bp, mouse
gactcctccgtcttctctac

SEQ ID NO: 854907 - DNA, 20 bp, mouse
gtctcctgtagagaagacgg

SEQ ID NO: 854908 - DNA, 20 bp, mouse
gcaacagaactgtgtccgtt

SEQ ID NO: 854909 - DNA, 20 bp, mouse
gctgttggtacatagcgata

SEQ ID NO: 854910 - DNA, 20 bp, mouse
gctttctcctgtagagaaga

SEQ ID NO: 854911 - DNA, 20 bp, mouse
gaacatgggcgtggtagcaa

SEQ ID NO: 854912 - DNA, 20 bp, mouse
ggcgccctcctttgagcaaa

SEQ ID NO: 854913 - DNA, 20 bp, mouse
gtttgagcaaaaggtacttc

SEQ ID NO: 854914 - DNA, 20 bp, mouse
gagaactgtgtccgttaggc

SEQ ID NO: 854915 - DNA, 20 bp, mouse
ggctcgtctagcctgcctaa

SEQ ID NO: 854916 - DNA, 20 bp, mouse
gcgggcctgggcaccggcca

SEQ ID NO: 854917 - DNA, 20 bp, mouse
gggcgggcggaaggcgactc

SEQ ID NO: 854918 - DNA, 20 bp, mouse
ggcgactcgggcctgggcac

SEQ ID NO: 854919 - DNA, 20 bp, mouse
ggctacgctgactccgggga

SEQ ID NO: 854920 - DNA, 20 bp, mouse
gtggcggcgggacctggctg

SEQ ID NO: 854921 - DNA, 20 bp, mouse
gcggaaggcgactcgggcct

SEQ ID NO: 854922 - DNA, 20 bp, mouse
ggggtcgcaccagcctgagg

SEQ ID NO: 854923 - DNA, 20 bp, mouse
gaccctggctacgctgactc

SEQ ID NO: 854924 - DNA, 20 bp, mouse
gaggaccgggactccgacct

SEQ ID NO: 854925 - DNA, 20 bp, mouse
ggcaccagcctgaggcggga

SEQ ID NO: 854926 - DNA, 20 bp, mouse
gaaaccggcaagtgaggatg

SEQ ID NO: 854927 - DNA, 20 bp, mouse
gatagtgactgggctctcgc

SEQ ID NO: 854928 - DNA, 20 bp, mouse
gatggggcgggcagaatagt

SEQ ID NO: 854929 - DNA, 20 bp, mouse
ggcgggcagaatagtgggac

SEQ ID NO: 854930 - DNA, 20 bp, mouse
ggggcgtgagcgggcttgag

SEQ ID NO: 854931 - DNA, 20 bp, mouse
ggtcgtcgatgatagtgact

SEQ ID NO: 854932 - DNA, 20 bp, mouse
gaaattcggggtgtggaaac

SEQ ID NO: 854933 - DNA, 20 bp, mouse
gcccctaccactgaaattcg

SEQ ID NO: 854934 - DNA, 20 bp, mouse
gactgcctctgatgacgtca

SEQ ID NO: 854935 - DNA, 20 bp, mouse
ggtgtggaaaccggcaagtg

SEQ ID NO: 854936 - DNA, 20 bp, mouse
ggtgaacaacccagttctgt

SEQ ID NO: 854937 - DNA, 20 bp, mouse
gaactgggttgttcacctgc

SEQ ID NO: 854938 - DNA, 20 bp, mouse
ggataaacatcactgtgaaa

SEQ ID NO: 854939 - DNA, 20 bp, mouse
gtcacagtcaggataccagc

SEQ ID NO: 854940 - DNA, 20 bp, mouse
gaaagtgcgagttttccatg

SEQ ID NO: 854941 - DNA, 20 bp, mouse
gcaggctaacattgcgtgct

SEQ ID NO: 854942 - DNA, 20 bp, mouse
ggactgtgattccttgaagt

SEQ ID NO: 854943 - DNA, 20 bp, mouse
gagagctcctgggatcgcag

SEQ ID NO: 854944 - DNA, 20 bp, mouse
ggtagcaggcagggtcacca

SEQ ID NO: 854945 - DNA, 20 bp, mouse
gatatgctgcgtagcaggca

SEQ ID NO: 854946 - DNA, 20 bp, mouse
gtcacgggtggcaggaattc

SEQ ID NO: 854947 - DNA, 20 bp, mouse
gtaaacaaggatctgcagat

SEQ ID NO: 854948 - DNA, 20 bp, mouse
gcgggtggcaggaattctgg

SEQ ID NO: 854949 - DNA, 20 bp, mouse
gcccgtgagtaggttaagtt

SEQ ID NO: 854950 - DNA, 20 bp, mouse
gtggtgacgtcaacgtggta

SEQ ID NO: 854951 - DNA, 20 bp, mouse
ggacaacaaactagttctgt

SEQ ID NO: 854952 - DNA, 20 bp, mouse
gtcgatgcacaggctaacat

SEQ ID NO: 854953 - DNA, 20 bp, mouse
gcagaaataactaggaaacg

SEQ ID NO: 854954 - DNA, 20 bp, mouse
gtgcctgcccccttcccctt

SEQ ID NO: 854955 - DNA, 20 bp, mouse
gtaacctactcacgggtggc

SEQ ID NO: 854956 - DNA, 20 bp, mouse
ggcgcagcccggaagatcat

SEQ ID NO: 854957 - DNA, 20 bp, mouse
ggagccgggaagccggacgt

SEQ ID NO: 854958 - DNA, 20 bp, mouse
ggccgccggcagcacaggag

SEQ ID NO: 854959 - DNA, 20 bp, mouse
gtagcagccaatgatcttcc

SEQ ID NO: 854960 - DNA, 20 bp, mouse
ggcccccggctgcctcacct

SEQ ID NO: 854961 - DNA, 20 bp, mouse
gggcctcggcgggtgcaaat

SEQ ID NO: 854962 - DNA, 20 bp, mouse
gacagattatgtaaccggca

SEQ ID NO: 854963 - DNA, 20 bp, mouse
ggagaggcggaagtgccgcg

SEQ ID NO: 854964 - DNA, 20 bp, mouse
ggaccgcgcagtcccacgtc

SEQ ID NO: 854965 - DNA, 20 bp, mouse
gggcagcggacggtgtctca

SEQ ID NO: 854966 - DNA, 20 bp, mouse
gccagagcttgcgtcggcga

SEQ ID NO: 854967 - DNA, 20 bp, mouse
gaaacgccggaggagctaca

SEQ ID NO: 854968 - DNA, 20 bp, mouse
gcgcactgcgacttccgccc

SEQ ID NO: 854969 - DNA, 20 bp, mouse
gtccgataaaacacgaactg

SEQ ID NO: 854970 - DNA, 20 bp, mouse
gggcagtgacgtcgacggaa

SEQ ID NO: 854971 - DNA, 20 bp, mouse
gctgagggcagtgacgtcga

SEQ ID NO: 854972 - DNA, 20 bp, mouse
gcaggcgggcggttgcctga

SEQ ID NO: 854973 - DNA, 20 bp, mouse
gcgcacttccgccaggcggg

SEQ ID NO: 854974 - DNA, 20 bp, mouse
gcgcatttaaatgactggaa

SEQ ID NO: 854975 - DNA, 20 bp, mouse
ggtacaacaccaggcccggg

SEQ ID NO: 854976 - DNA, 20 bp, mouse
ggtaaggcagggcttcctat

SEQ ID NO: 854977 - DNA, 20 bp, mouse
gttggcgctggttttcctat

SEQ ID NO: 854978 - DNA, 20 bp, mouse
ggccctgatgatctggtcgg

SEQ ID NO: 854979 - DNA, 20 bp, mouse
gaccaccgaccagatcatca

SEQ ID NO: 854980 - DNA, 20 bp, mouse
gtctctatgtagtcctgctc

SEQ ID NO: 854981 - DNA, 20 bp, mouse
gttggctgtattgtaaggca

SEQ ID NO: 854982 - DNA, 20 bp, mouse
gtctctgcattccctgtgat

SEQ ID NO: 854983 - DNA, 20 bp, mouse
gcttaaatgtcaccaaccat

SEQ ID NO: 854984 - DNA, 20 bp, mouse
gttggggagagacatcccgt

SEQ ID NO: 854985 - DNA, 20 bp, mouse
gcagcgccaacctctactta

SEQ ID NO: 854986 - DNA, 20 bp, mouse
gcactggcatagctctcaga

SEQ ID NO: 854987 - DNA, 20 bp, mouse
gccccacccccggacagaat

SEQ ID NO: 854988 - DNA, 20 bp, mouse
gcacctgctgtgctctagta

SEQ ID NO: 854989 - DNA, 20 bp, mouse
ggacgtctcccacaaaccac

SEQ ID NO: 854990 - DNA, 20 bp, mouse
gttcccaggggctaccgcgg

SEQ ID NO: 854991 - DNA, 20 bp, mouse
gtgtgctctagtagggacta

SEQ ID NO: 854992 - DNA, 20 bp, mouse
gtaaacaaggcatacgtcgg

SEQ ID NO: 854993 - DNA, 20 bp, mouse
gtaaccacgccagttatatc

SEQ ID NO: 854994 - DNA, 20 bp, mouse
gagctatgccagtggtttgt

SEQ ID NO: 854995 - DNA, 20 bp, mouse
ggtccgctatagcgccgcca

SEQ ID NO: 854996 - DNA, 20 bp, mouse
gcccttccggtattccagaa

SEQ ID NO: 854997 - DNA, 20 bp, mouse
gctggacccttggccctttc

SEQ ID NO: 854998 - DNA, 20 bp, mouse
ggctgcaggttgcatgtctt

SEQ ID NO: 854999 - DNA, 20 bp, mouse
gcgggccatcatgtggtggg

SEQ ID NO: 855000 - DNA, 20 bp, mouse
ggaaccgggccatcatgtgg

SEQ ID NO: 855001 - DNA, 20 bp, mouse
ggtgaccaaagtctatctct

SEQ ID NO: 855002 - DNA, 20 bp, mouse
gaatgaagagatatctggtt

SEQ ID NO: 855003 - DNA, 20 bp, mouse
ggcctcataggaaactacaa

SEQ ID NO: 855004 - DNA, 20 bp, mouse
ggaaggaatgaagagatatc

SEQ ID NO: 855005 - DNA, 20 bp, mouse
gggagaaattggtttttctc

SEQ ID NO: 855006 - DNA, 20 bp, mouse
ggtgcctgggactgaaggat

SEQ ID NO: 855007 - DNA, 20 bp, mouse
gaagacgatgtcatcagcaa

SEQ ID NO: 855008 - DNA, 20 bp, mouse
gagtcggtgtggcccagtag

SEQ ID NO: 855009 - DNA, 20 bp, mouse
gcactggggcaaatgtgcct

SEQ ID NO: 855010 - DNA, 20 bp, mouse
gtcgtcttaagggaacatga

SEQ ID NO: 855011 - DNA, 20 bp, mouse
gtctgtcactagcttcacta

SEQ ID NO: 855012 - DNA, 20 bp, mouse
gttaagggaacatgaaggct

SEQ ID NO: 855013 - DNA, 20 bp, mouse
gaacagctgcagagtcggtg

SEQ ID NO: 855014 - DNA, 20 bp, mouse
ggacctaacagctgcagagt

SEQ ID NO: 855015 - DNA, 20 bp, mouse
ggtgcggagccattggagag

SEQ ID NO: 855016 - DNA, 20 bp, mouse
gtgcttcaagagcggtactt

SEQ ID NO: 855017 - DNA, 20 bp, mouse
gccgaggcctagaagggcgg

SEQ ID NO: 855018 - DNA, 20 bp, mouse
gtaaagtcggagcttgatga

SEQ ID NO: 855019 - DNA, 20 bp, mouse
gtctaggcctcggaaacaag

SEQ ID NO: 855020 - DNA, 20 bp, mouse
gtatcctgctgtcatcacct

SEQ ID NO: 855021 - DNA, 20 bp, mouse
ggacagcaggatagtttggt

SEQ ID NO: 855022 - DNA, 20 bp, mouse
ggcaccccccagagtcgacc

SEQ ID NO: 855023 - DNA, 20 bp, mouse
gagagaaccaccgcccttct

SEQ ID NO: 855024 - DNA, 20 bp, mouse
gtcgaccaggacacaccgcg

SEQ ID NO: 855025 - DNA, 20 bp, mouse
gcaagcggaacctaagagtc

SEQ ID NO: 855026 - DNA, 20 bp, mouse
gggtactccccgactttaaa

SEQ ID NO: 855027 - DNA, 20 bp, mouse
gggagcctcccctttaaagt

SEQ ID NO: 855028 - DNA, 20 bp, mouse
gtgtgctctggtggggacta

SEQ ID NO: 855029 - DNA, 20 bp, mouse
gggcttgtgagagttcccag

SEQ ID NO: 855030 - DNA, 20 bp, mouse
gctccccgactttaaagggg

SEQ ID NO: 855031 - DNA, 20 bp, mouse
gtaactgattttctctcctg

SEQ ID NO: 855032 - DNA, 20 bp, mouse
gggagtacccccctccccct

SEQ ID NO: 855033 - DNA, 20 bp, mouse
gacaggacgcagctctcaaa

SEQ ID NO: 855034 - DNA, 20 bp, mouse
ggtgagagttcccaggggga

SEQ ID NO: 855035 - DNA, 20 bp, mouse
gaactattttgatcacagga

SEQ ID NO: 855036 - DNA, 20 bp, mouse
gttctcttggctactgtagg

SEQ ID NO: 855037 - DNA, 20 bp, mouse
gtgaaactgggctctctcat

SEQ ID NO: 855038 - DNA, 20 bp, mouse
gaaacctcccgcaggacgaa

SEQ ID NO: 855039 - DNA, 20 bp, mouse
gacacactgagcgcgggtgg

SEQ ID NO: 855040 - DNA, 20 bp, mouse
gcggtggaaacccaggcgag

SEQ ID NO: 855041 - DNA, 20 bp, mouse
ggggttgcaaaacctcccgc

SEQ ID NO: 855042 - DNA, 20 bp, mouse
gcgaagggaggggggaaaat

SEQ ID NO: 855043 - DNA, 20 bp, mouse
gcggcgtccccgctctgtgc

SEQ ID NO: 855044 - DNA, 20 bp, mouse
gataaaacacacactgagcg

SEQ ID NO: 855045 - DNA, 20 bp, mouse
gggctgcgaagagaggatat

SEQ ID NO: 855046 - DNA, 20 bp, mouse
gccgcgatccgggacaacca

SEQ ID NO: 855047 - DNA, 20 bp, mouse
gctccatagcgcacggaatc

SEQ ID NO: 855048 - DNA, 20 bp, mouse
gtgcgctatggagtctggag

SEQ ID NO: 855049 - DNA, 20 bp, mouse
ggccggggccgctgtgtccg

SEQ ID NO: 855050 - DNA, 20 bp, mouse
ggatgcaggagctaagtcct

SEQ ID NO: 855051 - DNA, 20 bp, mouse
gcgggacaaccagggcagcc

SEQ ID NO: 855052 - DNA, 20 bp, mouse
gttgtcccggatcgcggcgg

SEQ ID NO: 855053 - DNA, 20 bp, mouse
gcagggcagcctggaagacc

SEQ ID NO: 855054 - DNA, 20 bp, mouse
gagccctgagaaaagaatgc

SEQ ID NO: 855055 - DNA, 20 bp, mouse
ggcctggaagacctggacac

SEQ ID NO: 855056 - DNA, 20 bp, mouse
gccaaagcctatacgtccta

SEQ ID NO: 855057 - DNA, 20 bp, mouse
gaggacccgtcgctctctcg

SEQ ID NO: 855058 - DNA, 20 bp, mouse
gcggagagcgctactaactg

SEQ ID NO: 855059 - DNA, 20 bp, mouse
gtggccggtcccgaagctag

SEQ ID NO: 855060 - DNA, 20 bp, mouse
ggctgtccaagactttctta

SEQ ID NO: 855061 - DNA, 20 bp, mouse
gtccggagctggagcaacta

SEQ ID NO: 855062 - DNA, 20 bp, mouse
ggacgccacgagagagcgac

SEQ ID NO: 855063 - DNA, 20 bp, mouse
ggacagcaacgtctttacat

SEQ ID NO: 855064 - DNA, 20 bp, mouse
gaacggaagtgaggatgcag

SEQ ID NO: 855065 - DNA, 20 bp, mouse
gtgacgctcggctccctcag

SEQ ID NO: 855066 - DNA, 20 bp, mouse
gggtgcccgcctggcctctg

SEQ ID NO: 855067 - DNA, 20 bp, mouse
ggactcaagctctttgtcgt

SEQ ID NO: 855068 - DNA, 20 bp, mouse
gaactcgggtggcctttctc

SEQ ID NO: 855069 - DNA, 20 bp, mouse
gtaaagctggaggtgccagc

SEQ ID NO: 855070 - DNA, 20 bp, mouse
gcaggcgggcaccccagaga

SEQ ID NO: 855071 - DNA, 20 bp, mouse
gcgggcaccccagagaggga

SEQ ID NO: 855072 - DNA, 20 bp, mouse
ggacaaagagcttgagtcct

SEQ ID NO: 855073 - DNA, 20 bp, mouse
ggtcttaggacccttactcc

SEQ ID NO: 855074 - DNA, 20 bp, mouse
gagggggcagcactcctaga

SEQ ID NO: 855075 - DNA, 20 bp, mouse
ggactgtgccagtgcgtcac

SEQ ID NO: 855076 - DNA, 20 bp, mouse
ggagaacagagtcgcaacta

SEQ ID NO: 855077 - DNA, 20 bp, mouse
gaaactgtacggtcagctca

SEQ ID NO: 855078 - DNA, 20 bp, mouse
gcacaaggggctctgtgtat

SEQ ID NO: 855079 - DNA, 20 bp, mouse
ggcgacctgactctgatact

SEQ ID NO: 855080 - DNA, 20 bp, mouse
ggcctgaccccagtcttgat

SEQ ID NO: 855081 - DNA, 20 bp, mouse
gactctgatactgggtttga

SEQ ID NO: 855082 - DNA, 20 bp, mouse
gatcagagtcaggtcgctgg

SEQ ID NO: 855083 - DNA, 20 bp, mouse
gagtgatccaatcaagactg

SEQ ID NO: 855084 - DNA, 20 bp, mouse
gagtcaggtcgctggaggcc

SEQ ID NO: 855085 - DNA, 20 bp, mouse
gtcaccgccatctttctttc

SEQ ID NO: 855086 - DNA, 20 bp, mouse
ggccaaaggagcggcaggta

SEQ ID NO: 855087 - DNA, 20 bp, mouse
ggaaccgcccggaagggaga

SEQ ID NO: 855088 - DNA, 20 bp, mouse
gccgcccggaagggagatgg

SEQ ID NO: 855089 - DNA, 20 bp, mouse
gtctgtgggcccagcaataa

SEQ ID NO: 855090 - DNA, 20 bp, mouse
gcgtccgggactcccacagt

SEQ ID NO: 855091 - DNA, 20 bp, mouse
ggacctcccgacctttccta

SEQ ID NO: 855092 - DNA, 20 bp, mouse
gttactgagaaccgcccgga

SEQ ID NO: 855093 - DNA, 20 bp, mouse
gggaagggagatggcggaca

SEQ ID NO: 855094 - DNA, 20 bp, mouse
gcggacaaggcgctgcctct

SEQ ID NO: 855095 - DNA, 20 bp, mouse
gagtggttgtgtcagtaaga

SEQ ID NO: 855096 - DNA, 20 bp, mouse
ggggccggcggggcgatctg

SEQ ID NO: 855097 - DNA, 20 bp, mouse
gggaccgcagatcgccccgc

SEQ ID NO: 855098 - DNA, 20 bp, mouse
gggggcccgcagcggctcgg

SEQ ID NO: 855099 - DNA, 20 bp, mouse
gtccccgcggcggtcccccc

SEQ ID NO: 855100 - DNA, 20 bp, mouse
gggaccggcggctttgtgtg

SEQ ID NO: 855101 - DNA, 20 bp, mouse
ggggcgatctgcggtccccg

SEQ ID NO: 855102 - DNA, 20 bp, mouse
gcccgcagcggctcggaggc

SEQ ID NO: 855103 - DNA, 20 bp, mouse
ggcgccgggggggaccgccg

SEQ ID NO: 855104 - DNA, 20 bp, mouse
ggcctctggtgggacagaag

SEQ ID NO: 855105 - DNA, 20 bp, mouse
gaggctggcgcgggaaagtt

SEQ ID NO: 855106 - DNA, 20 bp, mouse
ggcagcccagcgggtccttg

SEQ ID NO: 855107 - DNA, 20 bp, mouse
gacacgcaatggctagtata

SEQ ID NO: 855108 - DNA, 20 bp, mouse
gcgggccacaaggacccgct

SEQ ID NO: 855109 - DNA, 20 bp, mouse
gccttcacgtgtgtactcgg

SEQ ID NO: 855110 - DNA, 20 bp, mouse
gctagcaaggccggagtgac

SEQ ID NO: 855111 - DNA, 20 bp, mouse
gtagacggcaggtccagctc

SEQ ID NO: 855112 - DNA, 20 bp, mouse
ggcaggagtaagttcctaaa

SEQ ID NO: 855113 - DNA, 20 bp, mouse
gtactcgggggacaagccac

SEQ ID NO: 855114 - DNA, 20 bp, mouse
ggcgaacgcacgactctaga

SEQ ID NO: 855115 - DNA, 20 bp, mouse
gagaccagctgtccaataaa

SEQ ID NO: 855116 - DNA, 20 bp, mouse
gcagaccagccgggattagg

SEQ ID NO: 855117 - DNA, 20 bp, mouse
gtggtctgcccggagaggaa

SEQ ID NO: 855118 - DNA, 20 bp, mouse
ggctggggagagtcttagga

SEQ ID NO: 855119 - DNA, 20 bp, mouse
gcacgtgacccgcagtttgt

SEQ ID NO: 855120 - DNA, 20 bp, mouse
ggggcagaccagccgggatt

SEQ ID NO: 855121 - DNA, 20 bp, mouse
gggctgggaagttgagatca

SEQ ID NO: 855122 - DNA, 20 bp, mouse
ggaggactgactcgatggtc

SEQ ID NO: 855123 - DNA, 20 bp, mouse
gctggcctcctaatcccggc

SEQ ID NO: 855124 - DNA, 20 bp, mouse
gcaattccggggtgcattgg

SEQ ID NO: 855125 - DNA, 20 bp, mouse
gcctctccgggcagaccagc

SEQ ID NO: 855126 - DNA, 20 bp, mouse
ggtgacgaggtcagagggat

SEQ ID NO: 855127 - DNA, 20 bp, mouse
gccgccctgtcaatcaaagg

SEQ ID NO: 855128 - DNA, 20 bp, mouse
gttgccgtgacgaggtcaga

SEQ ID NO: 855129 - DNA, 20 bp, mouse
gggatgccgctgcctcctga

SEQ ID NO: 855130 - DNA, 20 bp, mouse
ggcagtcccagaaccatccc

SEQ ID NO: 855131 - DNA, 20 bp, mouse
gggcgacagcgtggaacttc

SEQ ID NO: 855132 - DNA, 20 bp, mouse
gcgcccacctttgattgaca

SEQ ID NO: 855133 - DNA, 20 bp, mouse
ggtgagggaaagaagggcgt

SEQ ID NO: 855134 - DNA, 20 bp, mouse
gtcagagggatgggcttgtg

SEQ ID NO: 855135 - DNA, 20 bp, mouse
gctgcctcctgagggcttag

SEQ ID NO: 855136 - DNA, 20 bp, mouse
gacccagtgcgcagacgcgg

SEQ ID NO: 855137 - DNA, 20 bp, mouse
gtggcccggaagtctgtgac

SEQ ID NO: 855138 - DNA, 20 bp, mouse
ggggtcctccggctgaccgc

SEQ ID NO: 855139 - DNA, 20 bp, mouse
gcacgtgggtgtgggattag

SEQ ID NO: 855140 - DNA, 20 bp, mouse
gaggacccagtgcgcagacg

SEQ ID NO: 855141 - DNA, 20 bp, mouse
gccgcccggaggacatccgt

SEQ ID NO: 855142 - DNA, 20 bp, mouse
gagccaccgcgtctgcgcac

SEQ ID NO: 855143 - DNA, 20 bp, mouse
gcactctaggataagaatgg

SEQ ID NO: 855144 - DNA, 20 bp, mouse
gacacccacgtgcgcaaaca

SEQ ID NO: 855145 - DNA, 20 bp, mouse
gccagattcctgcggtcagc

SEQ ID NO: 855146 - DNA, 20 bp, mouse
gagcttggcagggtggatca

SEQ ID NO: 855147 - DNA, 20 bp, mouse
gactttgagtctcgtgggag

SEQ ID NO: 855148 - DNA, 20 bp, mouse
gtacagactttgagtctcgt

SEQ ID NO: 855149 - DNA, 20 bp, mouse
gttaaaaatctgcatagcca

SEQ ID NO: 855150 - DNA, 20 bp, mouse
gtctcctcatgctgggttca

SEQ ID NO: 855151 - DNA, 20 bp, mouse
gaagatctatatagcttggc

SEQ ID NO: 855152 - DNA, 20 bp, mouse
gaatctgcatagccagggca

SEQ ID NO: 855153 - DNA, 20 bp, mouse
gaacttcccacttaaaagaa

SEQ ID NO: 855154 - DNA, 20 bp, mouse
gtctatatagcttggcaggg

SEQ ID NO: 855155 - DNA, 20 bp, mouse
gtgaaaacagataaacgggc

SEQ ID NO: 855156 - DNA, 20 bp, mouse
gtatccgaaagtctcagcac

SEQ ID NO: 855157 - DNA, 20 bp, mouse
ggggtctgcgtgtacaccac

SEQ ID NO: 855158 - DNA, 20 bp, mouse
gaaaaaaagcaggcttgtag

SEQ ID NO: 855159 - DNA, 20 bp, mouse
gcaggcaggggaaaaaaagc

SEQ ID NO: 855160 - DNA, 20 bp, mouse
gtcgccagatgcagaatccc

SEQ ID NO: 855161 - DNA, 20 bp, mouse
gggtccaagcctcaggcccg

SEQ ID NO: 855162 - DNA, 20 bp, mouse
gagaccctgttccctcgtgc

SEQ ID NO: 855163 - DNA, 20 bp, mouse
ggcgaaccccagcagtgggt

SEQ ID NO: 855164 - DNA, 20 bp, mouse
gacccccgggattctgcatc

SEQ ID NO: 855165 - DNA, 20 bp, mouse
ggcgtcatgacgcacgaagg

SEQ ID NO: 855166 - DNA, 20 bp, mouse
gagcctgggaaaaaatgagg

SEQ ID NO: 855167 - DNA, 20 bp, mouse
gccagtgtctagtggaatca

SEQ ID NO: 855168 - DNA, 20 bp, mouse
gtccactagacactgggaga

SEQ ID NO: 855169 - DNA, 20 bp, mouse
gcccctctcccagtgtctag

SEQ ID NO: 855170 - DNA, 20 bp, mouse
gacggaagatcagcttttgg

SEQ ID NO: 855171 - DNA, 20 bp, mouse
gagaggccggcgaaggtctt

SEQ ID NO: 855172 - DNA, 20 bp, mouse
ggagcggctggcagagtctt

SEQ ID NO: 855173 - DNA, 20 bp, mouse
gtgagatcagcttaactgag

SEQ ID NO: 855174 - DNA, 20 bp, mouse
gctagaggggcccgggaagc

SEQ ID NO: 855175 - DNA, 20 bp, mouse
ggagacctgaccaccggtgg

SEQ ID NO: 855176 - DNA, 20 bp, mouse
gagctgcggcagaaacgcgg

SEQ ID NO: 855177 - DNA, 20 bp, mouse
gaagactcagggttccctat

SEQ ID NO: 855178 - DNA, 20 bp, mouse
gggggagcgccgtcctgtgg

SEQ ID NO: 855179 - DNA, 20 bp, mouse
gtcgccggaccacaactccc

SEQ ID NO: 855180 - DNA, 20 bp, mouse
gccgtcctgtggaggagcgg

SEQ ID NO: 855181 - DNA, 20 bp, mouse
ggtggggagcccaggtccga

SEQ ID NO: 855182 - DNA, 20 bp, mouse
gggagcggtggttgaagctt

SEQ ID NO: 855183 - DNA, 20 bp, mouse
gccgagctgcggcagaaacg

SEQ ID NO: 855184 - DNA, 20 bp, mouse
ggccccgcgtaggtgcccta

SEQ ID NO: 855185 - DNA, 20 bp, mouse
gggtggctgcttctggttgt

SEQ ID NO: 855186 - DNA, 20 bp, mouse
ggggacagcgctgacctcag

SEQ ID NO: 855187 - DNA, 20 bp, mouse
gggcccggatgtgcccgtag

SEQ ID NO: 855188 - DNA, 20 bp, mouse
gcgggccgcgagagtaaaga

SEQ ID NO: 855189 - DNA, 20 bp, mouse
gaaccctaaggatgagggcg

SEQ ID NO: 855190 - DNA, 20 bp, mouse
gtcagcgctgtcccactcat

SEQ ID NO: 855191 - DNA, 20 bp, mouse
gtccgggctagataagtcca

SEQ ID NO: 855192 - DNA, 20 bp, mouse
gggcgggaaccctaaggatg

SEQ ID NO: 855193 - DNA, 20 bp, mouse
gctgacctcaggggggaagg

SEQ ID NO: 855194 - DNA, 20 bp, mouse
ggtcccctacgggcacatcc

SEQ ID NO: 855195 - DNA, 20 bp, mouse
gacggggggcgggaacccta

SEQ ID NO: 855196 - DNA, 20 bp, mouse
gatcccggggtgctccccta

SEQ ID NO: 855197 - DNA, 20 bp, mouse
gcggcagcgtaacaccgggg

SEQ ID NO: 855198 - DNA, 20 bp, mouse
gaaggcgaccacagagtccc

SEQ ID NO: 855199 - DNA, 20 bp, mouse
gatgcctgggatagggtgga

SEQ ID NO: 855200 - DNA, 20 bp, mouse
gggaatgagcgtctccagga

SEQ ID NO: 855201 - DNA, 20 bp, mouse
gccctggcatgcctgggata

SEQ ID NO: 855202 - DNA, 20 bp, mouse
ggatccctccaccctatccc

SEQ ID NO: 855203 - DNA, 20 bp, mouse
gtgctcccctagggcagatc

SEQ ID NO: 855204 - DNA, 20 bp, mouse
gagagcaccgcctgggagtc

SEQ ID NO: 855205 - DNA, 20 bp, mouse
gtggagggatcggtgtactc

SEQ ID NO: 855206 - DNA, 20 bp, mouse
gacttcatgtttctgcaaga

SEQ ID NO: 855207 - DNA, 20 bp, mouse
gcccctgcatatagcaccca

SEQ ID NO: 855208 - DNA, 20 bp, mouse
gattgagagggagattgcaa

SEQ ID NO: 855209 - DNA, 20 bp, mouse
gtgctcatgactttaatcag

SEQ ID NO: 855210 - DNA, 20 bp, mouse
gagaatacaacttctgtgtc

SEQ ID NO: 855211 - DNA, 20 bp, mouse
gcatctatgcaaccaattcc

SEQ ID NO: 855212 - DNA, 20 bp, mouse
gtccttgggtgctatatgca

SEQ ID NO: 855213 - DNA, 20 bp, mouse
gtttaatcagaggcacagga

SEQ ID NO: 855214 - DNA, 20 bp, mouse
gtgactttaatcagaggcac

SEQ ID NO: 855215 - DNA, 20 bp, mouse
ggaacttcagtgcagaacta

SEQ ID NO: 855216 - DNA, 20 bp, mouse
ggcgcctggcggtagggtgg

SEQ ID NO: 855217 - DNA, 20 bp, mouse
gcgggggtgggagttcaaga

SEQ ID NO: 855218 - DNA, 20 bp, mouse
gtgtctggagggttagtcct

SEQ ID NO: 855219 - DNA, 20 bp, mouse
gcgggagcagcaaagcccgt

SEQ ID NO: 855220 - DNA, 20 bp, mouse
gcccacggcgcctggcggta

SEQ ID NO: 855221 - DNA, 20 bp, mouse
gggtgggagttcaagagggt

SEQ ID NO: 855222 - DNA, 20 bp, mouse
gggggcgggcacgggtggag

SEQ ID NO: 855223 - DNA, 20 bp, mouse
gcgccgtgggaggtcgcagg

SEQ ID NO: 855224 - DNA, 20 bp, mouse
ggtgggaggtcgcaggcggt

SEQ ID NO: 855225 - DNA, 20 bp, mouse
ggacctcccacggcgcctgg

SEQ ID NO: 855226 - DNA, 20 bp, mouse
ggaggcgcgcccgtgctctc

SEQ ID NO: 855227 - DNA, 20 bp, mouse
gcctcgctggcttcccccgg

SEQ ID NO: 855228 - DNA, 20 bp, mouse
gttggggcgggaacctcctc

SEQ ID NO: 855229 - DNA, 20 bp, mouse
ggagcacgggcgcgcctcgc

SEQ ID NO: 855230 - DNA, 20 bp, mouse
gtccggcggcccgagagcac

SEQ ID NO: 855231 - DNA, 20 bp, mouse
gaggccggaggcgagaagcg

SEQ ID NO: 855232 - DNA, 20 bp, mouse
gaggcacgctccaaatatgg

SEQ ID NO: 855233 - DNA, 20 bp, mouse
gggagtggttaggtcaccgc

SEQ ID NO: 855234 - DNA, 20 bp, mouse
gcccgtgccaatcagaccca

SEQ ID NO: 855235 - DNA, 20 bp, mouse
ggggcctattccaccttaaa

SEQ ID NO: 855236 - DNA, 20 bp, mouse
gcccacccggaacctagcgc

SEQ ID NO: 855237 - DNA, 20 bp, mouse
gacgccgcgccgacctgcgt

SEQ ID NO: 855238 - DNA, 20 bp, mouse
gcggaaacactgcccgcggg

SEQ ID NO: 855239 - DNA, 20 bp, mouse
gcgccggaagcgtgtccgtg

SEQ ID NO: 855240 - DNA, 20 bp, mouse
gtgcgcccgcagcggagcgt

SEQ ID NO: 855241 - DNA, 20 bp, mouse
gtggctccgcccacgcaggt

SEQ ID NO: 855242 - DNA, 20 bp, mouse
gctaactctgcagcccgggc

SEQ ID NO: 855243 - DNA, 20 bp, mouse
gtccgctgcgggcgcagctc

SEQ ID NO: 855244 - DNA, 20 bp, mouse
gccgagctcgaggccggccc

SEQ ID NO: 855245 - DNA, 20 bp, mouse
ggcttccggcgctaggttcc

SEQ ID NO: 855246 - DNA, 20 bp, mouse
gcggaggcctacgctctcgg

SEQ ID NO: 855247 - DNA, 20 bp, mouse
gccggggccaccgagagcgt

SEQ ID NO: 855248 - DNA, 20 bp, mouse
gcccaccccaagtcccggac

SEQ ID NO: 855249 - DNA, 20 bp, mouse
ggtctctctaggcacagcgg

SEQ ID NO: 855250 - DNA, 20 bp, mouse
ggacgactgcgcagacgggg

SEQ ID NO: 855251 - DNA, 20 bp, mouse
ggggcaagcacagatcttgg

SEQ ID NO: 855252 - DNA, 20 bp, mouse
gcagcccgagtcagcctgat

SEQ ID NO: 855253 - DNA, 20 bp, mouse
gaaggccctcgggagaagag

SEQ ID NO: 855254 - DNA, 20 bp, mouse
ggggaggcactcggatttgt

SEQ ID NO: 855255 - DNA, 20 bp, mouse
gtcaaagagcaggcgcggtc

SEQ ID NO: 855256 - DNA, 20 bp, mouse
gagggaaggcggggaaccga

SEQ ID NO: 855257 - DNA, 20 bp, mouse
ggtggcaggaagggaaggcg

SEQ ID NO: 855258 - DNA, 20 bp, mouse
ggagccagctgtggcaggaa

SEQ ID NO: 855259 - DNA, 20 bp, mouse
gtggacccacagctctgtat

SEQ ID NO: 855260 - DNA, 20 bp, mouse
gctagactagggatgaagtg

SEQ ID NO: 855261 - DNA, 20 bp, mouse
ggaggagagccagctgtggc

SEQ ID NO: 855262 - DNA, 20 bp, mouse
ggagaggggctcaggaggtg

SEQ ID NO: 855263 - DNA, 20 bp, mouse
gggaggttcgcgagcacagc

SEQ ID NO: 855264 - DNA, 20 bp, mouse
ggactgagaggcctctgagg

SEQ ID NO: 855265 - DNA, 20 bp, mouse
gggcctctcagtcctcctgc

SEQ ID NO: 855266 - DNA, 20 bp, mouse
ggaccccgaggctctcccga

SEQ ID NO: 855267 - DNA, 20 bp, mouse
gccgccctgcgtgctggctg

SEQ ID NO: 855268 - DNA, 20 bp, mouse
gccgacccggctggtgacgt

SEQ ID NO: 855269 - DNA, 20 bp, mouse
gcaccagccgggtcggtccg

SEQ ID NO: 855270 - DNA, 20 bp, mouse
ggagggcagctgcatcgaga

SEQ ID NO: 855271 - DNA, 20 bp, mouse
gcgaacttcccagcaaagaa

SEQ ID NO: 855272 - DNA, 20 bp, mouse
ggccaggccgccctgcgtgc

SEQ ID NO: 855273 - DNA, 20 bp, mouse
gcagccggagtcacaggggg

SEQ ID NO: 855274 - DNA, 20 bp, mouse
gctgccctcgggagagcctc

SEQ ID NO: 855275 - DNA, 20 bp, mouse
gaggggagcaggtgggtcgg

SEQ ID NO: 855276 - DNA, 20 bp, mouse
ggacccccatagccggggat

SEQ ID NO: 855277 - DNA, 20 bp, mouse
gcggcctcgcgcgctcggaa

SEQ ID NO: 855278 - DNA, 20 bp, mouse
ggggatgtcgtgcgcgaagg

SEQ ID NO: 855279 - DNA, 20 bp, mouse
gggcccagagcgcagacgtt

SEQ ID NO: 855280 - DNA, 20 bp, mouse
gcagccgagcagataaccgc

SEQ ID NO: 855281 - DNA, 20 bp, mouse
gaagggggcagggaggccgg

SEQ ID NO: 855282 - DNA, 20 bp, mouse
ggaagggagtcgcgagacgt

SEQ ID NO: 855283 - DNA, 20 bp, mouse
ggagtcgcgagacgtcggag

SEQ ID NO: 855284 - DNA, 20 bp, mouse
gagcgcccaggtaaagtcgt

SEQ ID NO: 855285 - DNA, 20 bp, mouse
gcggcggccacgtagcgctg

SEQ ID NO: 855286 - DNA, 20 bp, mouse
gtcaacagaacgcacttcca

SEQ ID NO: 855287 - DNA, 20 bp, mouse
gccgccgggagatttctcac

SEQ ID NO: 855288 - DNA, 20 bp, mouse
gctgcccgcggcgccaaacg

SEQ ID NO: 855289 - DNA, 20 bp, mouse
gcgcatgcgcgtagtccgtc

SEQ ID NO: 855290 - DNA, 20 bp, mouse
gggctctgcaggtaaggtga

SEQ ID NO: 855291 - DNA, 20 bp, mouse
gcgcgtagtccgtccggccc

SEQ ID NO: 855292 - DNA, 20 bp, mouse
gaggtgctgaatttgagcgc

SEQ ID NO: 855293 - DNA, 20 bp, mouse
ggtccgtccggcccaggcca

SEQ ID NO: 855294 - DNA, 20 bp, mouse
gtgtccccgtttggcgccgc

SEQ ID NO: 855295 - DNA, 20 bp, mouse
ggccgaagaattcaatagag

SEQ ID NO: 855296 - DNA, 20 bp, mouse
gacggtgtggtaggcatcta

SEQ ID NO: 855297 - DNA, 20 bp, mouse
ggaagagctttacagacgtc

SEQ ID NO: 855298 - DNA, 20 bp, mouse
ggtaaagctcttcaacggtg

SEQ ID NO: 855299 - DNA, 20 bp, mouse
gaagtaattcaaaacgaaca

SEQ ID NO: 855300 - DNA, 20 bp, mouse
gcttcactatactcttcatc

SEQ ID NO: 855301 - DNA, 20 bp, mouse
gttacgaagttccaaaactc

SEQ ID NO: 855302 - DNA, 20 bp, mouse
gagctcttcaacggtgtggt

SEQ ID NO: 855303 - DNA, 20 bp, mouse
gtcttttttagactacttga

SEQ ID NO: 855304 - DNA, 20 bp, mouse
ggatctcaacacaaatttgt

SEQ ID NO: 855305 - DNA, 20 bp, mouse
gaatgatctagagattgtca

SEQ ID NO: 855306 - DNA, 20 bp, mouse
gacacgggatgcggtctcgt

SEQ ID NO: 855307 - DNA, 20 bp, mouse
ggcgccctaatcagcaggga

SEQ ID NO: 855308 - DNA, 20 bp, mouse
gcagccctccctgctgatta

SEQ ID NO: 855309 - DNA, 20 bp, mouse
gtcagctgacagctcgaccc

SEQ ID NO: 855310 - DNA, 20 bp, mouse
ggggatgcggtctcgtgggt

SEQ ID NO: 855311 - DNA, 20 bp, mouse
gcggtcccgggtgaggttcc

SEQ ID NO: 855312 - DNA, 20 bp, mouse
gcaggagggcgacagaggtt

SEQ ID NO: 855313 - DNA, 20 bp, mouse
ggcgacggaagtccacggga

SEQ ID NO: 855314 - DNA, 20 bp, mouse
gcgaagcacaacagcaacta

SEQ ID NO: 855315 - DNA, 20 bp, mouse
gtccacgggagggcggtccc

SEQ ID NO: 855316 - DNA, 20 bp, mouse
gtggccatgacagctcctaa

SEQ ID NO: 855317 - DNA, 20 bp, mouse
ggaagatccaagtgaagtat

SEQ ID NO: 855318 - DNA, 20 bp, mouse
ggtgacacagtgaaagtcca

SEQ ID NO: 855319 - DNA, 20 bp, mouse
gtatgtgcacactgtgatgg

SEQ ID NO: 855320 - DNA, 20 bp, mouse
ggcttcgccagcctccacaa

SEQ ID NO: 855321 - DNA, 20 bp, mouse
gtatcattgtattgtgggag

SEQ ID NO: 855322 - DNA, 20 bp, mouse
gcataagcaggcaaagcttg

SEQ ID NO: 855323 - DNA, 20 bp, mouse
gcccacaatacaatgataca

SEQ ID NO: 855324 - DNA, 20 bp, mouse
ggattcgcagtaaacggaag

SEQ ID NO: 855325 - DNA, 20 bp, mouse
gtgacactgaggcttttcat

SEQ ID NO: 855326 - DNA, 20 bp, mouse
gccggcgcgccgtgagatga

SEQ ID NO: 855327 - DNA, 20 bp, mouse
gctgtggtgctgaaacggat

SEQ ID NO: 855328 - DNA, 20 bp, mouse
gcgtttcagcaccacagacc

SEQ ID NO: 855329 - DNA, 20 bp, mouse
gtgctgaaacggataggacc

SEQ ID NO: 855330 - DNA, 20 bp, mouse
gacgggtaaaatcctgcaca

SEQ ID NO: 855331 - DNA, 20 bp, mouse
gaatcgaacttgtgctgttt

SEQ ID NO: 855332 - DNA, 20 bp, mouse
gctggagtgcaaccttgtgc

SEQ ID NO: 855333 - DNA, 20 bp, mouse
ggcaaaggcaacactatgat

SEQ ID NO: 855334 - DNA, 20 bp, mouse
gctctgaagcagtaggtaga

SEQ ID NO: 855335 - DNA, 20 bp, mouse
gcctggctttcagaaaaaat

SEQ ID NO: 855336 - DNA, 20 bp, mouse
gcccgatgggcgggcgccgt

SEQ ID NO: 855337 - DNA, 20 bp, mouse
gggagtctggaatgtgatgg

SEQ ID NO: 855338 - DNA, 20 bp, mouse
ggggcagggatcaacactag

SEQ ID NO: 855339 - DNA, 20 bp, mouse
gtgggcgggcgccgtgggaa

SEQ ID NO: 855340 - DNA, 20 bp, mouse
ggcgccgtgggaacggagtc

SEQ ID NO: 855341 - DNA, 20 bp, mouse
gatgcgcagcagagatgcta

SEQ ID NO: 855342 - DNA, 20 bp, mouse
gaatgtgatggaggccaaga

SEQ ID NO: 855343 - DNA, 20 bp, mouse
ggccaagagggtcgcgggaa

SEQ ID NO: 855344 - DNA, 20 bp, mouse
gcatggtacttggcattctt

SEQ ID NO: 855345 - DNA, 20 bp, mouse
gtaaaaaatgcccgatgggc

SEQ ID NO: 855346 - DNA, 20 bp, mouse
gcggttgcccggggtaacca

SEQ ID NO: 855347 - DNA, 20 bp, mouse
gttgcccggggtaaccaggg

SEQ ID NO: 855348 - DNA, 20 bp, mouse
gcagacgcctccgggaggat

SEQ ID NO: 855349 - DNA, 20 bp, mouse
gccctcccatgggaggggcg

SEQ ID NO: 855350 - DNA, 20 bp, mouse
ggacgacgcgccactccctg

SEQ ID NO: 855351 - DNA, 20 bp, mouse
gcagccccattccctcccat

SEQ ID NO: 855352 - DNA, 20 bp, mouse
gcgcacgcgcgttcccgctc

SEQ ID NO: 855353 - DNA, 20 bp, mouse
gcaagcgcactgctcaggtg

SEQ ID NO: 855354 - DNA, 20 bp, mouse
gctcaggtgcggccgcactg

SEQ ID NO: 855355 - DNA, 20 bp, mouse
ggcatcgcacgcatgcgtcc

SEQ ID NO: 855356 - DNA, 20 bp, mouse
gtggcctcgcgctgtctccg

SEQ ID NO: 855357 - DNA, 20 bp, mouse
gtggaagcccagtgagtccg

SEQ ID NO: 855358 - DNA, 20 bp, mouse
gtaggagggcgcacacgggt

SEQ ID NO: 855359 - DNA, 20 bp, mouse
gcgcccctccagaaggacgc

SEQ ID NO: 855360 - DNA, 20 bp, mouse
gagcgtaggagggcgcacac

SEQ ID NO: 855361 - DNA, 20 bp, mouse
ggcgtctagttgcgtgtcag

SEQ ID NO: 855362 - DNA, 20 bp, mouse
gggcgtggctccgcgctccg

SEQ ID NO: 855363 - DNA, 20 bp, mouse
gaacgctaggagaagcatcc

SEQ ID NO: 855364 - DNA, 20 bp, mouse
gaggccctgaagggatccct

SEQ ID NO: 855365 - DNA, 20 bp, mouse
ggaaccccggagacagcgcg

SEQ ID NO: 855366 - DNA, 20 bp, mouse
gggcacgccgggctgattga

SEQ ID NO: 855367 - DNA, 20 bp, mouse
gcggacacccgccaagtcgc

SEQ ID NO: 855368 - DNA, 20 bp, mouse
gacgccgggctgattgacgg

SEQ ID NO: 855369 - DNA, 20 bp, mouse
ggcgctaggacccggaggga

SEQ ID NO: 855370 - DNA, 20 bp, mouse
gaggtgggacgatgcggaga

SEQ ID NO: 855371 - DNA, 20 bp, mouse
ggctgaggggctggcacgcc

SEQ ID NO: 855372 - DNA, 20 bp, mouse
gacgccgcgccgacctgcgt

SEQ ID NO: 855373 - DNA, 20 bp, mouse
gcgggaggaaggaaaaactt

SEQ ID NO: 855374 - DNA, 20 bp, mouse
gcagagaagtatcttgcgaa

SEQ ID NO: 855375 - DNA, 20 bp, mouse
gagcgtctgcaggagctagg

SEQ ID NO: 855376 - DNA, 20 bp, mouse
gtcaactccgccctctgcca

SEQ ID NO: 855377 - DNA, 20 bp, mouse
ggacacccgaacggagagac

SEQ ID NO: 855378 - DNA, 20 bp, mouse
gcgttcgggtgtccacgcgt

SEQ ID NO: 855379 - DNA, 20 bp, mouse
gggccgtatagaccactcga

SEQ ID NO: 855380 - DNA, 20 bp, mouse
gaaggggcgggcgcagtgca

SEQ ID NO: 855381 - DNA, 20 bp, mouse
gtagcagaagggcccacgcg

SEQ ID NO: 855382 - DNA, 20 bp, mouse
gctaacctgtctctccgttc

SEQ ID NO: 855383 - DNA, 20 bp, mouse
ggccaccttgagctgagtca

SEQ ID NO: 855384 - DNA, 20 bp, mouse
ggctactggtctccctcgag

SEQ ID NO: 855385 - DNA, 20 bp, mouse
gctccctcgagtggtctata

SEQ ID NO: 855386 - DNA, 20 bp, mouse
gagccagggctggggtgaga

SEQ ID NO: 855387 - DNA, 20 bp, mouse
gggagaaagcagtacatcgc

SEQ ID NO: 855388 - DNA, 20 bp, mouse
gaggaaagacagccagggct

SEQ ID NO: 855389 - DNA, 20 bp, mouse
gcgcgggatgaattcagctc

SEQ ID NO: 855390 - DNA, 20 bp, mouse
gggactgtcttccacgggga

SEQ ID NO: 855391 - DNA, 20 bp, mouse
gttgcggaagtgtatagagt

SEQ ID NO: 855392 - DNA, 20 bp, mouse
gactgatatgaccctcccta

SEQ ID NO: 855393 - DNA, 20 bp, mouse
gccgctcacccggaaataga

SEQ ID NO: 855394 - DNA, 20 bp, mouse
gagctcgggactagtagcaa

SEQ ID NO: 855395 - DNA, 20 bp, mouse
ggaagtgtatagagtgggcg

SEQ ID NO: 855396 - DNA, 20 bp, mouse
gggcgccaacgcacagctgt

SEQ ID NO: 855397 - DNA, 20 bp, mouse
gacccggagccctgtccaat

SEQ ID NO: 855398 - DNA, 20 bp, mouse
gcggagccctgtccaatcgg

SEQ ID NO: 855399 - DNA, 20 bp, mouse
ggccatctactgtcactcaa

SEQ ID NO: 855400 - DNA, 20 bp, mouse
gagctcctacagctgtgcgt

SEQ ID NO: 855401 - DNA, 20 bp, mouse
gccccttgagtgacagtaga

SEQ ID NO: 855402 - DNA, 20 bp, mouse
gtcagtgcctccgattggac

SEQ ID NO: 855403 - DNA, 20 bp, mouse
gcggctcccagacaaaggac

SEQ ID NO: 855404 - DNA, 20 bp, mouse
gtcaactcagtgcctccgat

SEQ ID NO: 855405 - DNA, 20 bp, mouse
gtgtccaatcagacacacag

SEQ ID NO: 855406 - DNA, 20 bp, mouse
ggagaggcagcgtagcagag

SEQ ID NO: 855407 - DNA, 20 bp, mouse
ggtggggaacactgtaactc

SEQ ID NO: 855408 - DNA, 20 bp, mouse
gtagcactggttctctcact

SEQ ID NO: 855409 - DNA, 20 bp, mouse
gcatttgagaaatggaagac

SEQ ID NO: 855410 - DNA, 20 bp, mouse
gtacatggataaactgggcg

SEQ ID NO: 855411 - DNA, 20 bp, mouse
gcatcaatacatggagatca

SEQ ID NO: 855412 - DNA, 20 bp, mouse
gccaaaaagtgaagaaaact

SEQ ID NO: 855413 - DNA, 20 bp, mouse
gcatcaatacatggataaac

SEQ ID NO: 855414 - DNA, 20 bp, mouse
ggctgggttctacctagcac

SEQ ID NO: 855415 - DNA, 20 bp, mouse
gaagacagttgtcagccaga

SEQ ID NO: 855416 - DNA, 20 bp, mouse
gaaagcgggcagcccggact

SEQ ID NO: 855417 - DNA, 20 bp, mouse
gagtgatgagaagactatga

SEQ ID NO: 855418 - DNA, 20 bp, mouse
gcaacccaaagcgaagacta

SEQ ID NO: 855419 - DNA, 20 bp, mouse
ggcgtctaggggaacctcgt

SEQ ID NO: 855420 - DNA, 20 bp, mouse
ggttccgagcggggtatgga

SEQ ID NO: 855421 - DNA, 20 bp, mouse
ggactccggagcagccaatg

SEQ ID NO: 855422 - DNA, 20 bp, mouse
gcccggactaggagcacgga

SEQ ID NO: 855423 - DNA, 20 bp, mouse
gatgaggggccagttccgag

SEQ ID NO: 855424 - DNA, 20 bp, mouse
ggccccacccagtcccgtat

SEQ ID NO: 855425 - DNA, 20 bp, mouse
gtggagaaggttctccccat

SEQ ID NO: 855426 - DNA, 20 bp, mouse
gaacgcgtgcggaacgaacg

SEQ ID NO: 855427 - DNA, 20 bp, mouse
ggcagccttactggccgcaa

SEQ ID NO: 855428 - DNA, 20 bp, mouse
gtgaccaaggggcgtgccaa

SEQ ID NO: 855429 - DNA, 20 bp, mouse
gggaaccagcagtgaggccg

SEQ ID NO: 855430 - DNA, 20 bp, mouse
gcattcccttgcggccagta

SEQ ID NO: 855431 - DNA, 20 bp, mouse
gaaagacacgaaggtgtgaa

SEQ ID NO: 855432 - DNA, 20 bp, mouse
gccacccccggcctcactgc

SEQ ID NO: 855433 - DNA, 20 bp, mouse
gggccggaagcggaaggcta

SEQ ID NO: 855434 - DNA, 20 bp, mouse
gtgctcacacaaagacacga

SEQ ID NO: 855435 - DNA, 20 bp, mouse
gactggggagacactatctc

SEQ ID NO: 855436 - DNA, 20 bp, mouse
ggaagatcgggcgttctgat

SEQ ID NO: 855437 - DNA, 20 bp, mouse
ggaagccaacggattcttaa

SEQ ID NO: 855438 - DNA, 20 bp, mouse
gccgttggcttcattcaaat

SEQ ID NO: 855439 - DNA, 20 bp, mouse
gaacgaatgcaatagatagg

SEQ ID NO: 855440 - DNA, 20 bp, mouse
gtcataagacttctcacaac

SEQ ID NO: 855441 - DNA, 20 bp, mouse
gtctgattggtcatcaatga

SEQ ID NO: 855442 - DNA, 20 bp, mouse
gtgtgagaagtcttatgaat

SEQ ID NO: 855443 - DNA, 20 bp, mouse
gaagtagggcaaacaagcgt

SEQ ID NO: 855444 - DNA, 20 bp, mouse
ggattggtcatcaatgaagg

SEQ ID NO: 855445 - DNA, 20 bp, mouse
gcttgcccttaagaatccgt

SEQ ID NO: 855446 - DNA, 20 bp, mouse
ggccgcccgggcagacccag

SEQ ID NO: 855447 - DNA, 20 bp, mouse
ggggcggtgtccagcgaagc

SEQ ID NO: 855448 - DNA, 20 bp, mouse
gtacaggagaccctcagcag

SEQ ID NO: 855449 - DNA, 20 bp, mouse
ggacgcgagcagcgtggggt

SEQ ID NO: 855450 - DNA, 20 bp, mouse
ggggtcgcgcagcacccggg

SEQ ID NO: 855451 - DNA, 20 bp, mouse
ggacacgaaccgggctagag

SEQ ID NO: 855452 - DNA, 20 bp, mouse
gtcgccgggccacggggtac

SEQ ID NO: 855453 - DNA, 20 bp, mouse
gaagccggcagcccctgctg

SEQ ID NO: 855454 - DNA, 20 bp, mouse
ggcccgggcagacccagggg

SEQ ID NO: 855455 - DNA, 20 bp, mouse
gtgctgcgcgacccagatcc

SEQ ID NO: 855456 - DNA, 20 bp, mouse
gtgcacaagacctagtagga

SEQ ID NO: 855457 - DNA, 20 bp, mouse
gcactcccgcggctcggtca

SEQ ID NO: 855458 - DNA, 20 bp, mouse
gtaggacggccaataaacat

SEQ ID NO: 855459 - DNA, 20 bp, mouse
gtcaccgctgagttctgaac

SEQ ID NO: 855460 - DNA, 20 bp, mouse
gcgagccgcgggagtgaagt

SEQ ID NO: 855461 - DNA, 20 bp, mouse
ggatccgccttcacagcgtt

SEQ ID NO: 855462 - DNA, 20 bp, mouse
ggcgggagtgaagtgggtcg

SEQ ID NO: 855463 - DNA, 20 bp, mouse
gacagcggcgcctcggtggg

SEQ ID NO: 855464 - DNA, 20 bp, mouse
gtgcccagttcagaactcag

SEQ ID NO: 855465 - DNA, 20 bp, mouse
gccggagccggaacccagag

SEQ ID NO: 855466 - DNA, 20 bp, mouse
gttgcttggtggcaactgat

SEQ ID NO: 855467 - DNA, 20 bp, mouse
gcagctggagggtggtctcg

SEQ ID NO: 855468 - DNA, 20 bp, mouse
ggcagctcgcgtttgcttgg

SEQ ID NO: 855469 - DNA, 20 bp, mouse
gaggcagagatgctaataga

SEQ ID NO: 855470 - DNA, 20 bp, mouse
ggtggtctcgcggttcagaa

SEQ ID NO: 855471 - DNA, 20 bp, mouse
ggttcagaaaggactctagt

SEQ ID NO: 855472 - DNA, 20 bp, mouse
ggactctagttggcttcagc

SEQ ID NO: 855473 - DNA, 20 bp, mouse
ggaatcccagacagtcgttc

SEQ ID NO: 855474 - DNA, 20 bp, mouse
ggctttgcacggggctcccg

SEQ ID NO: 855475 - DNA, 20 bp, mouse
ggtggatggtggcaggttat

SEQ ID NO: 855476 - DNA, 20 bp, mouse
gcaaccgcgggctggcactc

SEQ ID NO: 855477 - DNA, 20 bp, mouse
gggtcctctcctccagtcct

SEQ ID NO: 855478 - DNA, 20 bp, mouse
gggggctctactcagacccc

SEQ ID NO: 855479 - DNA, 20 bp, mouse
ggccaccgcagcaacaacgg

SEQ ID NO: 855480 - DNA, 20 bp, mouse
gactcagaccccaggactgg

SEQ ID NO: 855481 - DNA, 20 bp, mouse
gcagggcagcaagcgtgtga

SEQ ID NO: 855482 - DNA, 20 bp, mouse
gcctgccaccgcagcaacaa

SEQ ID NO: 855483 - DNA, 20 bp, mouse
gggatcgcgactctaccaag

SEQ ID NO: 855484 - DNA, 20 bp, mouse
gtgtagtagctcggagccga

SEQ ID NO: 855485 - DNA, 20 bp, mouse
gcgagctactacagcccgac

SEQ ID NO: 855486 - DNA, 20 bp, mouse
ggcggggccagaagttgtca

SEQ ID NO: 855487 - DNA, 20 bp, mouse
gggctgggctagagactgag

SEQ ID NO: 855488 - DNA, 20 bp, mouse
gtgtggctgaaggtcaccga

SEQ ID NO: 855489 - DNA, 20 bp, mouse
gagttgtcacggcccataaa

SEQ ID NO: 855490 - DNA, 20 bp, mouse
ggaggcagggccgggaagtg

SEQ ID NO: 855491 - DNA, 20 bp, mouse
gaaggccaggcacgaccagg

SEQ ID NO: 855492 - DNA, 20 bp, mouse
gcgccccccgccaggttaca

SEQ ID NO: 855493 - DNA, 20 bp, mouse
gggctagagactgagaggca

SEQ ID NO: 855494 - DNA, 20 bp, mouse
gagcggaagtcgcccgggtg

SEQ ID NO: 855495 - DNA, 20 bp, mouse
gcacccctgtaacctggcgg

SEQ ID NO: 855496 - DNA, 20 bp, mouse
ggggaggcggcgaccggcta

SEQ ID NO: 855497 - DNA, 20 bp, mouse
gccccggcggtcccggggag

SEQ ID NO: 855498 - DNA, 20 bp, mouse
gtccagaagtcccgtccctt

SEQ ID NO: 855499 - DNA, 20 bp, mouse
gtagcccacgggtcacccaa

SEQ ID NO: 855500 - DNA, 20 bp, mouse
gcgtcccttgggtgacccgt

SEQ ID NO: 855501 - DNA, 20 bp, mouse
gcagatccagcgctgggcga

SEQ ID NO: 855502 - DNA, 20 bp, mouse
gtgcttcccactagtgtcta

SEQ ID NO: 855503 - DNA, 20 bp, mouse
gggaggcgggcgccgccggt

SEQ ID NO: 855504 - DNA, 20 bp, mouse
gccgggcacaacccgcaaag

SEQ ID NO: 855505 - DNA, 20 bp, mouse
gaagcagcaggcaacaggag

SEQ ID NO: 855506 - DNA, 20 bp, mouse
gagacatgggcccaggggca

SEQ ID NO: 855507 - DNA, 20 bp, mouse
gcctctggtgggaaaagcgt

SEQ ID NO: 855508 - DNA, 20 bp, mouse
gtgaggccacccttgcccct

SEQ ID NO: 855509 - DNA, 20 bp, mouse
ggcccatgtctccctctggt

SEQ ID NO: 855510 - DNA, 20 bp, mouse
gtgtgccaaccccaggtttg

SEQ ID NO: 855511 - DNA, 20 bp, mouse
gcggcttcccagcagttggc

SEQ ID NO: 855512 - DNA, 20 bp, mouse
gcaggaaggcagcgaggact

SEQ ID NO: 855513 - DNA, 20 bp, mouse
gtctccatgactgaggactc

SEQ ID NO: 855514 - DNA, 20 bp, mouse
gaacctggggttggcacacc

SEQ ID NO: 855515 - DNA, 20 bp, mouse
gtctccgttcagacaaaacc

SEQ ID NO: 855516 - DNA, 20 bp, mouse
gaggacgcgggcatgctaga

SEQ ID NO: 855517 - DNA, 20 bp, mouse
gcccgcgcgcttatgtaaca

SEQ ID NO: 855518 - DNA, 20 bp, mouse
ggggcctaagacgggaactg

SEQ ID NO: 855519 - DNA, 20 bp, mouse
gagagcgggcgggaagcaga

SEQ ID NO: 855520 - DNA, 20 bp, mouse
gagccgccgcaggaaggtga

SEQ ID NO: 855521 - DNA, 20 bp, mouse
ggccccgcagttcccgtctt

SEQ ID NO: 855522 - DNA, 20 bp, mouse
gtagcatgcccgcgtccttc

SEQ ID NO: 855523 - DNA, 20 bp, mouse
gcggaggtcacacaccgcaa

SEQ ID NO: 855524 - DNA, 20 bp, mouse
gacgacaccgagagagcggg

SEQ ID NO: 855525 - DNA, 20 bp, mouse
gctgcagaccggaaggacgc

SEQ ID NO: 855526 - DNA, 20 bp, mouse
gaccacccatatcaacggaa

SEQ ID NO: 855527 - DNA, 20 bp, mouse
gagggcggggccagataaaa

SEQ ID NO: 855528 - DNA, 20 bp, mouse
gcaggagctggggaatccga

SEQ ID NO: 855529 - DNA, 20 bp, mouse
gtggagagttgaagtcagtg

SEQ ID NO: 855530 - DNA, 20 bp, mouse
gggaagggctgggcccctgg

SEQ ID NO: 855531 - DNA, 20 bp, mouse
gtgcgcgagcccgcccccag

SEQ ID NO: 855532 - DNA, 20 bp, mouse
gccagcccttccgttgatat

SEQ ID NO: 855533 - DNA, 20 bp, mouse
ggccggaagacgcttctgat

SEQ ID NO: 855534 - DNA, 20 bp, mouse
gacctccttccagtgggctc

SEQ ID NO: 855535 - DNA, 20 bp, mouse
gcacagaccacccatatcaa

SEQ ID NO: 855536 - DNA, 20 bp, mouse
ggcttgttacgtcacatcga

SEQ ID NO: 855537 - DNA, 20 bp, mouse
gcacaggttctgccgctaga

SEQ ID NO: 855538 - DNA, 20 bp, mouse
ggatgtgacgtaacaagcaa

SEQ ID NO: 855539 - DNA, 20 bp, mouse
gctgctcacaactgtgatgt

SEQ ID NO: 855540 - DNA, 20 bp, mouse
gtgtttccatcctttcacat

SEQ ID NO: 855541 - DNA, 20 bp, mouse
gaagaactcaaaaggcgctc

SEQ ID NO: 855542 - DNA, 20 bp, mouse
gttcccataagtctgtgtaa

SEQ ID NO: 855543 - DNA, 20 bp, mouse
ggctttgaagacaggttcgg

SEQ ID NO: 855544 - DNA, 20 bp, mouse
gactcagctctgctaactgt

SEQ ID NO: 855545 - DNA, 20 bp, mouse
gctccattacacagacttat

SEQ ID NO: 855546 - DNA, 20 bp, mouse
gtctccctgactttggttca

SEQ ID NO: 855547 - DNA, 20 bp, mouse
gtaatacaagttgccgtcaa

SEQ ID NO: 855548 - DNA, 20 bp, mouse
gacaagttgccgtcaaaggc

SEQ ID NO: 855549 - DNA, 20 bp, mouse
gaacctggattgctgtccat

SEQ ID NO: 855550 - DNA, 20 bp, mouse
gagcagcctaatccagtgac

SEQ ID NO: 855551 - DNA, 20 bp, mouse
ggaatccagaagaaatacaa

SEQ ID NO: 855552 - DNA, 20 bp, mouse
gggagtagagtccggtctag

SEQ ID NO: 855553 - DNA, 20 bp, mouse
gtggggttcctagagtcttt

SEQ ID NO: 855554 - DNA, 20 bp, mouse
gacgttacctaaaaagctct

SEQ ID NO: 855555 - DNA, 20 bp, mouse
gaaatagttctccctgactt

SEQ ID NO: 855556 - DNA, 20 bp, mouse
gctaaagtgtcacatggcta

SEQ ID NO: 855557 - DNA, 20 bp, mouse
gacagcacccgaaaatgaga

SEQ ID NO: 855558 - DNA, 20 bp, mouse
ggctgtcccgcgcatccttg

SEQ ID NO: 855559 - DNA, 20 bp, mouse
gacagctctcggtccaccca

SEQ ID NO: 855560 - DNA, 20 bp, mouse
gctggctcacggaaaaagga

SEQ ID NO: 855561 - DNA, 20 bp, mouse
gtcgtggcagctgaggtagt

SEQ ID NO: 855562 - DNA, 20 bp, mouse
ggccttcaccaaggctcccg

SEQ ID NO: 855563 - DNA, 20 bp, mouse
gaagtgtcacatggctaggg

SEQ ID NO: 855564 - DNA, 20 bp, mouse
gttgagctcgtacagctctg

SEQ ID NO: 855565 - DNA, 20 bp, mouse
gtcaccaaggctcccggggt

SEQ ID NO: 855566 - DNA, 20 bp, mouse
gacacctgggatggtttcga

SEQ ID NO: 855567 - DNA, 20 bp, mouse
gagaagaggtcttgtgcagc

SEQ ID NO: 855568 - DNA, 20 bp, mouse
gctgatgacgtcactgggga

SEQ ID NO: 855569 - DNA, 20 bp, mouse
gctttctgatgacgtcactg

SEQ ID NO: 855570 - DNA, 20 bp, mouse
gtaaggaagcacgagtccga

SEQ ID NO: 855571 - DNA, 20 bp, mouse
gcctcttgcgagagattcac

SEQ ID NO: 855572 - DNA, 20 bp, mouse
gttagaatcttactaaggag

SEQ ID NO: 855573 - DNA, 20 bp, mouse
gaattcagtcttatacacct

SEQ ID NO: 855574 - DNA, 20 bp, mouse
gcagtcttatacacctggga

SEQ ID NO: 855575 - DNA, 20 bp, mouse
ggaatctctcgcaagaggag

SEQ ID NO: 855576 - DNA, 20 bp, mouse
ggcagtgcaccgaactcctt

SEQ ID NO: 855577 - DNA, 20 bp, mouse
gacttccaggaacacaccaa

SEQ ID NO: 855578 - DNA, 20 bp, mouse
gggaacacaccaaaggagtt

SEQ ID NO: 855579 - DNA, 20 bp, mouse
gggagttcggtgcactgcct

SEQ ID NO: 855580 - DNA, 20 bp, mouse
gtggtaccaacggccccttc

SEQ ID NO: 855581 - DNA, 20 bp, mouse
gctggagtcgtcataattgt

SEQ ID NO: 855582 - DNA, 20 bp, mouse
gctcccacaaatcagtgtaa

SEQ ID NO: 855583 - DNA, 20 bp, mouse
gaattatgacgactccagaa

SEQ ID NO: 855584 - DNA, 20 bp, mouse
gatttcacttgctcacactt

SEQ ID NO: 855585 - DNA, 20 bp, mouse
gcgactccagaaggggccgt

SEQ ID NO: 855586 - DNA, 20 bp, mouse
gaaaaaaaagagaagcctcc

SEQ ID NO: 855587 - DNA, 20 bp, mouse
gtccctgccaggcacaaagg

SEQ ID NO: 855588 - DNA, 20 bp, mouse
ggggaacaaagattaacaag

SEQ ID NO: 855589 - DNA, 20 bp, mouse
gacctcgcatggaaatgggg

SEQ ID NO: 855590 - DNA, 20 bp, mouse
ggagcagcccccaggaagtc

SEQ ID NO: 855591 - DNA, 20 bp, mouse
gccaggcttgcaattcgagt

SEQ ID NO: 855592 - DNA, 20 bp, mouse
gggcaccccagacttcctgg

SEQ ID NO: 855593 - DNA, 20 bp, mouse
gaaaaagaaaacttgggccg

SEQ ID NO: 855594 - DNA, 20 bp, mouse
ggctccagagagcagccccc

SEQ ID NO: 855595 - DNA, 20 bp, mouse
gagaagaaaaatcctctctg

SEQ ID NO: 855596 - DNA, 20 bp, mouse
gtccaccggcggcgcagcct

SEQ ID NO: 855597 - DNA, 20 bp, mouse
gccagcgcgggctccacggt

SEQ ID NO: 855598 - DNA, 20 bp, mouse
gcccgcgctgggttcgtgct

SEQ ID NO: 855599 - DNA, 20 bp, mouse
gttcccacggaaactcctca

SEQ ID NO: 855600 - DNA, 20 bp, mouse
ggccccctaccctgcagcaa

SEQ ID NO: 855601 - DNA, 20 bp, mouse
gcgtgcgcgcgctccccctt

SEQ ID NO: 855602 - DNA, 20 bp, mouse
gcgcactcggactccaccgg

SEQ ID NO: 855603 - DNA, 20 bp, mouse
ggtccctgaggagtttccgt

SEQ ID NO: 855604 - DNA, 20 bp, mouse
gtacccttgctgcagggtag

SEQ ID NO: 855605 - DNA, 20 bp, mouse
ggcagccaaggctgcgccgc

SEQ ID NO: 855606 - DNA, 20 bp, mouse
gtctgaaggtggatagccac

SEQ ID NO: 855607 - DNA, 20 bp, mouse
gggctatccaccttcagaag

SEQ ID NO: 855608 - DNA, 20 bp, mouse
gccgcggcgacgtcacaaac

SEQ ID NO: 855609 - DNA, 20 bp, mouse
gtggatagccacggggagtc

SEQ ID NO: 855610 - DNA, 20 bp, mouse
gagcgagtttcacaaagccg

SEQ ID NO: 855611 - DNA, 20 bp, mouse
gaacaagccacttctgaagg

SEQ ID NO: 855612 - DNA, 20 bp, mouse
gaacagcctgacagtaactt

SEQ ID NO: 855613 - DNA, 20 bp, mouse
gggaaatgtagtctcgtccg

SEQ ID NO: 855614 - DNA, 20 bp, mouse
gggctgtttgccaaagagaa

SEQ ID NO: 855615 - DNA, 20 bp, mouse
ggcggtaccctgactccccg

SEQ ID NO: 855616 - DNA, 20 bp, mouse
ggccgccaccacagtttcca

SEQ ID NO: 855617 - DNA, 20 bp, mouse
gagtgagctccggacgttgg

SEQ ID NO: 855618 - DNA, 20 bp, mouse
ggaagccgaagagtcccgga

SEQ ID NO: 855619 - DNA, 20 bp, mouse
gtggaatcaaagttcctgga

SEQ ID NO: 855620 - DNA, 20 bp, mouse
gcacatggaatcaaagttcc

SEQ ID NO: 855621 - DNA, 20 bp, mouse
gcacggaagccgaagagtcc

SEQ ID NO: 855622 - DNA, 20 bp, mouse
ggtcagcatggcagaccggg

SEQ ID NO: 855623 - DNA, 20 bp, mouse
ggtgagtgagctccggacgt

SEQ ID NO: 855624 - DNA, 20 bp, mouse
gtcgggtcaaaagtgttagt

SEQ ID NO: 855625 - DNA, 20 bp, mouse
gaatcaaagttcctggatgg

SEQ ID NO: 855626 - DNA, 20 bp, mouse
ggctacgtggtagtgaactg

SEQ ID NO: 855627 - DNA, 20 bp, mouse
gtgcgcatgcgcgccaccca

SEQ ID NO: 855628 - DNA, 20 bp, mouse
gaccctggcaacgacaggag

SEQ ID NO: 855629 - DNA, 20 bp, mouse
gccacttccgatttgaataa

SEQ ID NO: 855630 - DNA, 20 bp, mouse
ggcatgcgcaccaccactgg

SEQ ID NO: 855631 - DNA, 20 bp, mouse
gtcacctatcacattcttgt

SEQ ID NO: 855632 - DNA, 20 bp, mouse
gccacactcccgtgacacag

SEQ ID NO: 855633 - DNA, 20 bp, mouse
gcgcgcatgcgcaccaccac

SEQ ID NO: 855634 - DNA, 20 bp, mouse
ggatgcttgcctctgtgtca

SEQ ID NO: 855635 - DNA, 20 bp, mouse
gttcagccatggcactttct

SEQ ID NO: 855636 - DNA, 20 bp, mouse
gttacatggaggcttaaagc

SEQ ID NO: 855637 - DNA, 20 bp, mouse
gtaacaatggaatttcttct

SEQ ID NO: 855638 - DNA, 20 bp, mouse
ggatctaggagttaatttct

SEQ ID NO: 855639 - DNA, 20 bp, mouse
gtagaataaatgttgaacta

SEQ ID NO: 855640 - DNA, 20 bp, mouse
gaatacataactttatttat

SEQ ID NO: 855641 - DNA, 20 bp, mouse
ggacacattaagaagtatga

SEQ ID NO: 855642 - DNA, 20 bp, mouse
ggagggacaaaaggctttgt

SEQ ID NO: 855643 - DNA, 20 bp, mouse
gtagtcagcatgatttaaat

SEQ ID NO: 855644 - DNA, 20 bp, mouse
gaatgaatctttttatatta

SEQ ID NO: 855645 - DNA, 20 bp, mouse
ggcatgatttaaattggcat

SEQ ID NO: 855646 - DNA, 20 bp, mouse
ggcaatgaatgctctgcatt

SEQ ID NO: 855647 - DNA, 20 bp, mouse
gataaaagcatctctgtgag

SEQ ID NO: 855648 - DNA, 20 bp, mouse
gatgtgtgtatctgttagct

SEQ ID NO: 855649 - DNA, 20 bp, mouse
ggaaccccgggaacccagga

SEQ ID NO: 855650 - DNA, 20 bp, mouse
gacgggaaccccgggaaccc

SEQ ID NO: 855651 - DNA, 20 bp, mouse
ggcgtccacctcagctggca

SEQ ID NO: 855652 - DNA, 20 bp, mouse
ggaaccttcctgggttcccg

SEQ ID NO: 855653 - DNA, 20 bp, mouse
ggtgtcttccttgccagctg

SEQ ID NO: 855654 - DNA, 20 bp, mouse
gaccattgtgagaactgcac

SEQ ID NO: 855655 - DNA, 20 bp, mouse
ggtgttgcgtccacctcagc

SEQ ID NO: 855656 - DNA, 20 bp, mouse
gtaaggaagctcgattccga

SEQ ID NO: 855657 - DNA, 20 bp, mouse
gctttctgatgacctcacaa

SEQ ID NO: 855658 - DNA, 20 bp, mouse
gcaagtgctcagaaaatact

SEQ ID NO: 855659 - DNA, 20 bp, mouse
gtgtagtcccgtcccttgtg

SEQ ID NO: 855660 - DNA, 20 bp, mouse
gaggaagataatgtaagagt

SEQ ID NO: 855661 - DNA, 20 bp, mouse
gttagcatcttactacggag

SEQ ID NO: 855662 - DNA, 20 bp, mouse
gaattctgtcttaagtacct

SEQ ID NO: 855663 - DNA, 20 bp, mouse
ggctgaagttagaaaaaaac

SEQ ID NO: 855664 - DNA, 20 bp, mouse
ggagctgtgcccctcctctt

SEQ ID NO: 855665 - DNA, 20 bp, mouse
ggaggaggggcacagctcct

SEQ ID NO: 855666 - DNA, 20 bp, mouse
gggagagagccctgatccaa

SEQ ID NO: 855667 - DNA, 20 bp, mouse
gataaagaggtagacaatct

SEQ ID NO: 855668 - DNA, 20 bp, mouse
gagaactagactatggggtc

SEQ ID NO: 855669 - DNA, 20 bp, mouse
ggaccatccccatcataaag

SEQ ID NO: 855670 - DNA, 20 bp, mouse
gctcggctatgagactttca

SEQ ID NO: 855671 - DNA, 20 bp, mouse
gaacactgtcggtcagaaca

SEQ ID NO: 855672 - DNA, 20 bp, mouse
gcaagagtttgtgactccgg

SEQ ID NO: 855673 - DNA, 20 bp, mouse
gtgtgtgagaactagactat

SEQ ID NO: 855674 - DNA, 20 bp, mouse
gctatgagactttcagggtt

SEQ ID NO: 855675 - DNA, 20 bp, mouse
ggtcacaaactcttggtagc

SEQ ID NO: 855676 - DNA, 20 bp, mouse
gggccctccgaaaaggggtg

SEQ ID NO: 855677 - DNA, 20 bp, mouse
gggcccggaggaccggagga

SEQ ID NO: 855678 - DNA, 20 bp, mouse
gcggaggagggtggtgcgaa

SEQ ID NO: 855679 - DNA, 20 bp, mouse
gagggggggccctccgaaaa

SEQ ID NO: 855680 - DNA, 20 bp, mouse
gcgctcgcgcgccacggcgc

SEQ ID NO: 855681 - DNA, 20 bp, mouse
gaggagggtggtgcgaaggg

SEQ ID NO: 855682 - DNA, 20 bp, mouse
gtgcagctggcgagcgggag

SEQ ID NO: 855683 - DNA, 20 bp, mouse
ggagctgccctcagtgaaga

SEQ ID NO: 855684 - DNA, 20 bp, mouse
gagagctgcagctggcgagc

SEQ ID NO: 855685 - DNA, 20 bp, mouse
gcgggagggggacggcccgg

SEQ ID NO: 855686 - DNA, 20 bp, mouse
gggggcgtggcgatatgcgg

SEQ ID NO: 855687 - DNA, 20 bp, mouse
gaaaccaggtggcacatcgc

SEQ ID NO: 855688 - DNA, 20 bp, mouse
gtatgcgggggcgtggtcgg

SEQ ID NO: 855689 - DNA, 20 bp, mouse
gcgggggcgtggtcggaggt

SEQ ID NO: 855690 - DNA, 20 bp, mouse
gaggcggggcctcgtgagga

SEQ ID NO: 855691 - DNA, 20 bp, mouse
gagggcggggccaagcgcgg

SEQ ID NO: 855692 - DNA, 20 bp, mouse
gtggccccgccctcctcacg

SEQ ID NO: 855693 - DNA, 20 bp, mouse
gtgctacagctggacagctg

SEQ ID NO: 855694 - DNA, 20 bp, mouse
ggggcctcgtgaggagggcg

SEQ ID NO: 855695 - DNA, 20 bp, mouse
ggccaagcgcggcggcaagc

SEQ ID NO: 855696 - DNA, 20 bp, mouse
gccacctagctgactgtgag

SEQ ID NO: 855697 - DNA, 20 bp, mouse
gcaggcagggtgtgtcatgt

SEQ ID NO: 855698 - DNA, 20 bp, mouse
gacccctctcacagtcagct

SEQ ID NO: 855699 - DNA, 20 bp, mouse
gaagtcacgtgatacaaccc

SEQ ID NO: 855700 - DNA, 20 bp, mouse
gggcttgatgtcattggtgc

SEQ ID NO: 855701 - DNA, 20 bp, mouse
gctggtggaaccaccccaat

SEQ ID NO: 855702 - DNA, 20 bp, mouse
gccctgtttgtggtgctcac

SEQ ID NO: 855703 - DNA, 20 bp, mouse
ggcctgtgagcaccacaaac

SEQ ID NO: 855704 - DNA, 20 bp, mouse
gtcaaaactacgctccctag

SEQ ID NO: 855705 - DNA, 20 bp, mouse
gatcaagccctcaaccaaaa

SEQ ID NO: 855706 - DNA, 20 bp, mouse
ggggacagccatagggagtc

SEQ ID NO: 855707 - DNA, 20 bp, mouse
gactcacattcaaacatctc

SEQ ID NO: 855708 - DNA, 20 bp, mouse
gaaagcagcccgactcccta

SEQ ID NO: 855709 - DNA, 20 bp, mouse
ggacgaggcgccaggaaaac

SEQ ID NO: 855710 - DNA, 20 bp, mouse
gaggcgccaggaaaacaggc

SEQ ID NO: 855711 - DNA, 20 bp, mouse
gctcaggagcttaagacaga

SEQ ID NO: 855712 - DNA, 20 bp, mouse
gaaaatcccgggttcactac

SEQ ID NO: 855713 - DNA, 20 bp, mouse
gtcaaagtctacttattatg

SEQ ID NO: 855714 - DNA, 20 bp, mouse
gcagcaaacattagagtcaa

SEQ ID NO: 855715 - DNA, 20 bp, mouse
gtccttgtgaagcgatccaa

SEQ ID NO: 855716 - DNA, 20 bp, mouse
ggccactccaggtgccccac

SEQ ID NO: 855717 - DNA, 20 bp, mouse
gcgtgaacctagagtcctgt

SEQ ID NO: 855718 - DNA, 20 bp, mouse
gggggcacctggagtggcac

SEQ ID NO: 855719 - DNA, 20 bp, mouse
ggagggctgcccagttgcag

SEQ ID NO: 855720 - DNA, 20 bp, mouse
ggtcaccgggagaactaggg

SEQ ID NO: 855721 - DNA, 20 bp, mouse
gtctggatccctgctcagtg

SEQ ID NO: 855722 - DNA, 20 bp, mouse
gccacgtagcctcactgagc

SEQ ID NO: 855723 - DNA, 20 bp, mouse
gactctaggttcacggtgtg

SEQ ID NO: 855724 - DNA, 20 bp, mouse
gtagagtcctgtggggcacc

SEQ ID NO: 855725 - DNA, 20 bp, mouse
gcggtgtgtggggtcctggg

SEQ ID NO: 855726 - DNA, 20 bp, mouse
gccgcatctgaggagagtta

SEQ ID NO: 855727 - DNA, 20 bp, mouse
gcagccatcagccgcgcagc

SEQ ID NO: 855728 - DNA, 20 bp, mouse
gcaggtagcaaggggagtgg

SEQ ID NO: 855729 - DNA, 20 bp, mouse
gcgccgggctgcggtgcccc

SEQ ID NO: 855730 - DNA, 20 bp, mouse
gccatcagccgcgcagccgg

SEQ ID NO: 855731 - DNA, 20 bp, mouse
gtggcctggacatttggagc

SEQ ID NO: 855732 - DNA, 20 bp, mouse
ggactctaccaacgtaatta

SEQ ID NO: 855733 - DNA, 20 bp, mouse
gagaagagaacgcagctgga

SEQ ID NO: 855734 - DNA, 20 bp, mouse
gggagccgctccaaagatcg

SEQ ID NO: 855735 - DNA, 20 bp, mouse
gggacgcggttcccagtctc

SEQ ID NO: 855736 - DNA, 20 bp, mouse
gtggacatgcacagggaatt

SEQ ID NO: 855737 - DNA, 20 bp, mouse
gtaggcgggattaatgtgaa

SEQ ID NO: 855738 - DNA, 20 bp, mouse
gggtgcacatggacatgcac

SEQ ID NO: 855739 - DNA, 20 bp, mouse
gttccgggaacccactgaag

SEQ ID NO: 855740 - DNA, 20 bp, mouse
ggtagtcccggcccctgtga

SEQ ID NO: 855741 - DNA, 20 bp, mouse
ggataacatggaaacctgat

SEQ ID NO: 855742 - DNA, 20 bp, mouse
gagtccttccaattgatttg

SEQ ID NO: 855743 - DNA, 20 bp, mouse
gattacagtccactgagagc

SEQ ID NO: 855744 - DNA, 20 bp, mouse
gggggcgggacagagttact

SEQ ID NO: 855745 - DNA, 20 bp, mouse
gtgtgaaaggttcagctcac

SEQ ID NO: 855746 - DNA, 20 bp, mouse
gctccacggggcgggaaaac

SEQ ID NO: 855747 - DNA, 20 bp, mouse
gaaactaaagcccgcatgga

SEQ ID NO: 855748 - DNA, 20 bp, mouse
gaggcagcctgagacggagt

SEQ ID NO: 855749 - DNA, 20 bp, mouse
gggaccggtctccacggggc

SEQ ID NO: 855750 - DNA, 20 bp, mouse
gaaggcctggaaaactcaat

SEQ ID NO: 855751 - DNA, 20 bp, mouse
gtgggagggaccggtctcca

SEQ ID NO: 855752 - DNA, 20 bp, mouse
gggaaaactcaattggacaa

SEQ ID NO: 855753 - DNA, 20 bp, mouse
ggggtccgcctattatagat

SEQ ID NO: 855754 - DNA, 20 bp, mouse
gacaagggatttgaaccagt

SEQ ID NO: 855755 - DNA, 20 bp, mouse
ggatggcagtgctcatggtg

SEQ ID NO: 855756 - DNA, 20 bp, mouse
gtccgctattctaactgcac

SEQ ID NO: 855757 - DNA, 20 bp, mouse
gcccagtgcagttagaatag

SEQ ID NO: 855758 - DNA, 20 bp, mouse
gttataaaacaggtcggaac

SEQ ID NO: 855759 - DNA, 20 bp, mouse
gacgaaccggtacattcgga

SEQ ID NO: 855760 - DNA, 20 bp, mouse
ggtaacagcatccctgattg

SEQ ID NO: 855761 - DNA, 20 bp, mouse
gcaaacatggcggcaagggc

SEQ ID NO: 855762 - DNA, 20 bp, mouse
gcgggaccttccgaatgtac

SEQ ID NO: 855763 - DNA, 20 bp, mouse
ggaatgtaccggttcgtcat

SEQ ID NO: 855764 - DNA, 20 bp, mouse
gtcactatctttcctcaatc

SEQ ID NO: 855765 - DNA, 20 bp, mouse
gtttgattcaagttcttaat

SEQ ID NO: 855766 - DNA, 20 bp, mouse
gcaggcaggcagtctcatgt

SEQ ID NO: 855767 - DNA, 20 bp, mouse
ggaacaaatcccaggcagac

SEQ ID NO: 855768 - DNA, 20 bp, mouse
ggcctgtgaggaccacatac

SEQ ID NO: 855769 - DNA, 20 bp, mouse
gataaaaccaccacaactgg

SEQ ID NO: 855770 - DNA, 20 bp, mouse
gaagtcaagtaatgcaaccc

SEQ ID NO: 855771 - DNA, 20 bp, mouse
gctgataaaaccaccacaac

SEQ ID NO: 855772 - DNA, 20 bp, mouse
gagcagggagttaagatttc

SEQ ID NO: 855773 - DNA, 20 bp, mouse
gaaccttttagaagattgga

SEQ ID NO: 855774 - DNA, 20 bp, mouse
gatttaaccttttagaagat

SEQ ID NO: 855775 - DNA, 20 bp, mouse
gggctggaagaaattgatgc

SEQ ID NO: 855776 - DNA, 20 bp, mouse
ggctaggggccgagactaga

SEQ ID NO: 855777 - DNA, 20 bp, mouse
ggggctgggagttgtggctg

SEQ ID NO: 855778 - DNA, 20 bp, mouse
ggcccgggagatccagtcca

SEQ ID NO: 855779 - DNA, 20 bp, mouse
gcccccgcgcgtcgtggcct

SEQ ID NO: 855780 - DNA, 20 bp, mouse
gaggggcgaggcgactcctc

SEQ ID NO: 855781 - DNA, 20 bp, mouse
ggtagcccggccggggctag

SEQ ID NO: 855782 - DNA, 20 bp, mouse
ggtcgtggcctcggaggtga

SEQ ID NO: 855783 - DNA, 20 bp, mouse
gacaatcggggaccttggga

SEQ ID NO: 855784 - DNA, 20 bp, mouse
gtagtctcggcccctagccc

SEQ ID NO: 855785 - DNA, 20 bp, mouse
gccgcgcgtcgtggcctcgg

SEQ ID NO: 855786 - DNA, 20 bp, mouse
gtgaagggtcggtaacagta

SEQ ID NO: 855787 - DNA, 20 bp, mouse
gcattgtggaagtcccagaa

SEQ ID NO: 855788 - DNA, 20 bp, mouse
gagggcccaaagatcgtgag

SEQ ID NO: 855789 - DNA, 20 bp, mouse
gccctggcaggacaatggat

SEQ ID NO: 855790 - DNA, 20 bp, mouse
ggtaaaacgccagctcttat

SEQ ID NO: 855791 - DNA, 20 bp, mouse
gttcaggcgcgctctgaatg

SEQ ID NO: 855792 - DNA, 20 bp, mouse
gcttacaaaaaattatgaat

SEQ ID NO: 855793 - DNA, 20 bp, mouse
gtgttaccgacccttcattg

SEQ ID NO: 855794 - DNA, 20 bp, mouse
gaacatcctctcacgatctt

SEQ ID NO: 855795 - DNA, 20 bp, mouse
ggctctgaatgtggtccgtc

SEQ ID NO: 855796 - DNA, 20 bp, mouse
gaggggtagccgggactcag

SEQ ID NO: 855797 - DNA, 20 bp, mouse
gcgggactcagaggtgtccg

SEQ ID NO: 855798 - DNA, 20 bp, mouse
gtacccctcccggggcggtt

SEQ ID NO: 855799 - DNA, 20 bp, mouse
gagtcccggctacccctccc

SEQ ID NO: 855800 - DNA, 20 bp, mouse
gtccctaaccgccccgggag

SEQ ID NO: 855801 - DNA, 20 bp, mouse
ggggcacagcaatctcggtg

SEQ ID NO: 855802 - DNA, 20 bp, mouse
ggggcgtcaagatccagcag

SEQ ID NO: 855803 - DNA, 20 bp, mouse
ggggccttgaaggccgggct

SEQ ID NO: 855804 - DNA, 20 bp, mouse
gtacgcgggcacagcaatct

SEQ ID NO: 855805 - DNA, 20 bp, mouse
gcgggctaggcatggtctgt

SEQ ID NO: 855806 - DNA, 20 bp, mouse
ggcatccctctgttcctggc

SEQ ID NO: 855807 - DNA, 20 bp, mouse
gcatgccagccaggaacaga

SEQ ID NO: 855808 - DNA, 20 bp, mouse
gtggctcaggtggtccctct

SEQ ID NO: 855809 - DNA, 20 bp, mouse
ggggagtttgggctgtgtgg

SEQ ID NO: 855810 - DNA, 20 bp, mouse
gttgggctgtgtggtggctg

SEQ ID NO: 855811 - DNA, 20 bp, mouse
gctctgtaaggttttctgtc

SEQ ID NO: 855812 - DNA, 20 bp, mouse
gggaacagagggatgctgag

SEQ ID NO: 855813 - DNA, 20 bp, mouse
gggggggaggcatgccagcc

SEQ ID NO: 855814 - DNA, 20 bp, mouse
gtgtgtggtggctgggggtt

SEQ ID NO: 855815 - DNA, 20 bp, mouse
ggccagcagttctggaattc

SEQ ID NO: 855816 - DNA, 20 bp, mouse
ggatcagggagttgaaacac

SEQ ID NO: 855817 - DNA, 20 bp, mouse
ggcaggggaagcgatatgta

SEQ ID NO: 855818 - DNA, 20 bp, mouse
gataaagtaaagtggattcc

SEQ ID NO: 855819 - DNA, 20 bp, mouse
gagcgtgcaccctggagacc

SEQ ID NO: 855820 - DNA, 20 bp, mouse
ggcataccggagtcagaccc

SEQ ID NO: 855821 - DNA, 20 bp, mouse
gcatcaaggataaagtaaag

SEQ ID NO: 855822 - DNA, 20 bp, mouse
gcgcagaagagcttaaccaa

SEQ ID NO: 855823 - DNA, 20 bp, mouse
gttacacatcagataggata

SEQ ID NO: 855824 - DNA, 20 bp, mouse
gcacatctgcagcagtgtcc

SEQ ID NO: 855825 - DNA, 20 bp, mouse
gaagcgttgggacaatgagt

SEQ ID NO: 855826 - DNA, 20 bp, mouse
gcaggtaaaaatgtgcagat

SEQ ID NO: 855827 - DNA, 20 bp, mouse
ggcagatgggaaggttacgt

SEQ ID NO: 855828 - DNA, 20 bp, mouse
ggaactgggtacatcaggta

SEQ ID NO: 855829 - DNA, 20 bp, mouse
gaggctgacaccctcagcgt

SEQ ID NO: 855830 - DNA, 20 bp, mouse
gaaactctagtgtggggatt

SEQ ID NO: 855831 - DNA, 20 bp, mouse
ggagttctatccactccctc

SEQ ID NO: 855832 - DNA, 20 bp, mouse
gacactctctacccacgctg

SEQ ID NO: 855833 - DNA, 20 bp, mouse
gaaaagcttgggctatgaga

SEQ ID NO: 855834 - DNA, 20 bp, mouse
gcaggtaaggatagatatgg

SEQ ID NO: 855835 - DNA, 20 bp, mouse
ggatgtacccagttcctgtg

SEQ ID NO: 855836 - DNA, 20 bp, mouse
ggcgcgctgggtctggaggc

SEQ ID NO: 855837 - DNA, 20 bp, mouse
gacacgccctgagcccgtcg

SEQ ID NO: 855838 - DNA, 20 bp, mouse
ggacgccaggtgagccgcga

SEQ ID NO: 855839 - DNA, 20 bp, mouse
gacgcgggctgtggatccaa

SEQ ID NO: 855840 - DNA, 20 bp, mouse
ggtggatccaaggggagcga

SEQ ID NO: 855841 - DNA, 20 bp, mouse
ggccgcgggcggaaggctgt

SEQ ID NO: 855842 - DNA, 20 bp, mouse
gcgcggctcccggtccctcg

SEQ ID NO: 855843 - DNA, 20 bp, mouse
gcaggtgagccgcgagggac

SEQ ID NO: 855844 - DNA, 20 bp, mouse
gggagcgaacagtgaggcgc

SEQ ID NO: 855845 - DNA, 20 bp, mouse
ggcgctggtcacatgaactc

SEQ ID NO: 855846 - DNA, 20 bp, mouse
ggaagtctgcgatgagaagc

SEQ ID NO: 855847 - DNA, 20 bp, mouse
ggaaactggagtaaggggcg

SEQ ID NO: 855848 - DNA, 20 bp, mouse
ggggctgggcttagatagga

SEQ ID NO: 855849 - DNA, 20 bp, mouse
gcgatgagaagcgggtacta

SEQ ID NO: 855850 - DNA, 20 bp, mouse
ggtactaagtgggtaagggg

SEQ ID NO: 855851 - DNA, 20 bp, mouse
gaagtttgatgtgaggggct

SEQ ID NO: 855852 - DNA, 20 bp, mouse
gggagagggcggtactaagt

SEQ ID NO: 855853 - DNA, 20 bp, mouse
ggaacagtttcttagactga

SEQ ID NO: 855854 - DNA, 20 bp, mouse
gtaagctcttaggtcgtcgc

SEQ ID NO: 855855 - DNA, 20 bp, mouse
ggggcggggcttggtggaga

SEQ ID NO: 855856 - DNA, 20 bp, mouse
gctcccgtgtggtgctcaaa

SEQ ID NO: 855857 - DNA, 20 bp, mouse
ggggaccctgaactcaggga

SEQ ID NO: 855858 - DNA, 20 bp, mouse
ggctgcgcctggtggtgtca

SEQ ID NO: 855859 - DNA, 20 bp, mouse
gcccacctgggagctgcgcc

SEQ ID NO: 855860 - DNA, 20 bp, mouse
gaatcagtggcgcgcagaag

SEQ ID NO: 855861 - DNA, 20 bp, mouse
gtgcttgtcagtccgctcca

SEQ ID NO: 855862 - DNA, 20 bp, mouse
gaccacacgggagcttttaa

SEQ ID NO: 855863 - DNA, 20 bp, mouse
gtccctaccaggtcacagcg

SEQ ID NO: 855864 - DNA, 20 bp, mouse
gggaaatgtagtccttgcgg

SEQ ID NO: 855865 - DNA, 20 bp, mouse
ggcgatccgagcttgctact

SEQ ID NO: 855866 - DNA, 20 bp, mouse
gggccctggcggggtaggat

SEQ ID NO: 855867 - DNA, 20 bp, mouse
gacctgtcggtcctccgcat

SEQ ID NO: 855868 - DNA, 20 bp, mouse
gcgaggggcgggatcataac

SEQ ID NO: 855869 - DNA, 20 bp, mouse
ggggtaggataggcggaatc

SEQ ID NO: 855870 - DNA, 20 bp, mouse
ggcgcggggcaggtcgacga

SEQ ID NO: 855871 - DNA, 20 bp, mouse
gataaaaagtggggagacat

SEQ ID NO: 855872 - DNA, 20 bp, mouse
ggggcaggtcgacgaggggc

SEQ ID NO: 855873 - DNA, 20 bp, mouse
gtagatgagcggggccctgg

SEQ ID NO: 855874 - DNA, 20 bp, mouse
gacattggaatgcgtcgcta

SEQ ID NO: 855875 - DNA, 20 bp, mouse
gcaagttcagtcagcccatg

SEQ ID NO: 855876 - DNA, 20 bp, mouse
ggcacccagtgcttgtctgg

SEQ ID NO: 855877 - DNA, 20 bp, mouse
gggcgtgctctcaatatgga

SEQ ID NO: 855878 - DNA, 20 bp, mouse
gtgtcactgtagggaagagt

SEQ ID NO: 855879 - DNA, 20 bp, mouse
ggagctctggagtcaagatg

SEQ ID NO: 855880 - DNA, 20 bp, mouse
ggcgctgtgagacaggatga

SEQ ID NO: 855881 - DNA, 20 bp, mouse
gactaagactggcaagaaaa

SEQ ID NO: 855882 - DNA, 20 bp, mouse
gaaagctacagaagggacgt

SEQ ID NO: 855883 - DNA, 20 bp, mouse
gtcaagatggggactaagac

SEQ ID NO: 855884 - DNA, 20 bp, mouse
ggctctcaatatggatggac

SEQ ID NO: 855885 - DNA, 20 bp, mouse
ggacaaagaacacacgagag

SEQ ID NO: 855886 - DNA, 20 bp, mouse
gacaggaggactggagtagt

SEQ ID NO: 855887 - DNA, 20 bp, mouse
gccagccttctgtccgggga

SEQ ID NO: 855888 - DNA, 20 bp, mouse
gatagagacgacaggaggac

SEQ ID NO: 855889 - DNA, 20 bp, mouse
ggctaccccctccggctcta

SEQ ID NO: 855890 - DNA, 20 bp, mouse
gagcgacgaggctgggttgg

SEQ ID NO: 855891 - DNA, 20 bp, mouse
ggcgccatagagcaaaacgg

SEQ ID NO: 855892 - DNA, 20 bp, mouse
gagtaaggtaatgtgacctc

SEQ ID NO: 855893 - DNA, 20 bp, mouse
gtagagtggcgaggtagcgg

SEQ ID NO: 855894 - DNA, 20 bp, mouse
gtagcggtggcggcctggga

SEQ ID NO: 855895 - DNA, 20 bp, mouse
gcgccccctccccggacaga

SEQ ID NO: 855896 - DNA, 20 bp, mouse
gctgccttcggccctatgtg

SEQ ID NO: 855897 - DNA, 20 bp, mouse
gagttctgggaggaagaaac

SEQ ID NO: 855898 - DNA, 20 bp, mouse
gtgggagtgactagcagtac

SEQ ID NO: 855899 - DNA, 20 bp, mouse
gcctcccgctggcactcgat

SEQ ID NO: 855900 - DNA, 20 bp, mouse
gttaagctgcacatgactga

SEQ ID NO: 855901 - DNA, 20 bp, mouse
gcagccgagccagttctggg

SEQ ID NO: 855902 - DNA, 20 bp, mouse
gatagggccgaaggcagggc

SEQ ID NO: 855903 - DNA, 20 bp, mouse
gaagacagccgagccagttc

SEQ ID NO: 855904 - DNA, 20 bp, mouse
gggtccgcacatagggccga

SEQ ID NO: 855905 - DNA, 20 bp, mouse
gggagaggtacgcaatggac

SEQ ID NO: 855906 - DNA, 20 bp, mouse
gtactcgagccatgcgcctc

SEQ ID NO: 855907 - DNA, 20 bp, mouse
ggggtcgaggagcctgatct

SEQ ID NO: 855908 - DNA, 20 bp, mouse
gtcagcactgcgagtttcca

SEQ ID NO: 855909 - DNA, 20 bp, mouse
gggaagttggggccacagac

SEQ ID NO: 855910 - DNA, 20 bp, mouse
gaaagtgttcggctattcgt

SEQ ID NO: 855911 - DNA, 20 bp, mouse
gaggccgtgctggtgaccgg

SEQ ID NO: 855912 - DNA, 20 bp, mouse
ggcgcctccggtcaccagca

SEQ ID NO: 855913 - DNA, 20 bp, mouse
gaatcgtgaggaaatcccag

SEQ ID NO: 855914 - DNA, 20 bp, mouse
gtccagcaggaagtcgaatt

SEQ ID NO: 855915 - DNA, 20 bp, mouse
gctgagatagtgctgggtcg

SEQ ID NO: 855916 - DNA, 20 bp, mouse
gtagccgagggcttaagctg

SEQ ID NO: 855917 - DNA, 20 bp, mouse
gtgcagccgcttctgaataa

SEQ ID NO: 855918 - DNA, 20 bp, mouse
gaggaaaggtgactccctta

SEQ ID NO: 855919 - DNA, 20 bp, mouse
gcggctgcagaaagacgtcc

SEQ ID NO: 855920 - DNA, 20 bp, mouse
gctacctggtcaatcaggaa

SEQ ID NO: 855921 - DNA, 20 bp, mouse
gaagccccagcttaagccct

SEQ ID NO: 855922 - DNA, 20 bp, mouse
gctcggctacctggtcaatc

SEQ ID NO: 855923 - DNA, 20 bp, mouse
gaagggaatgcaaatattct

SEQ ID NO: 855924 - DNA, 20 bp, mouse
gaatagcctccatccctgga

SEQ ID NO: 855925 - DNA, 20 bp, mouse
gcccgcgcatgtgcataaca

SEQ ID NO: 855926 - DNA, 20 bp, mouse
ggggccgcagtcaaagacac

SEQ ID NO: 855927 - DNA, 20 bp, mouse
gctctccagagtaggaacca

SEQ ID NO: 855928 - DNA, 20 bp, mouse
gttgaccctggttcctactc

SEQ ID NO: 855929 - DNA, 20 bp, mouse
ggtcaactgtgaagtcttcc

SEQ ID NO: 855930 - DNA, 20 bp, mouse
ggggcaaaagtcaaagggtt

SEQ ID NO: 855931 - DNA, 20 bp, mouse
gacacaggacgacaatatgg

SEQ ID NO: 855932 - DNA, 20 bp, mouse
gaggcaggctcacggattgt

SEQ ID NO: 855933 - DNA, 20 bp, mouse
ggccaggtgctctccagagt

SEQ ID NO: 855934 - DNA, 20 bp, mouse
gaccaaacgttctccttgat

SEQ ID NO: 855935 - DNA, 20 bp, mouse
ggaagaccgaaactcctcat

SEQ ID NO: 855936 - DNA, 20 bp, mouse
gcggaggagggtagactgcg

SEQ ID NO: 855937 - DNA, 20 bp, mouse
ggacgcgcggggccggcctc

SEQ ID NO: 855938 - DNA, 20 bp, mouse
gcgcccgtgcgtcctcccgc

SEQ ID NO: 855939 - DNA, 20 bp, mouse
gacaagctcacggagtgggt

SEQ ID NO: 855940 - DNA, 20 bp, mouse
ggcggcgcgtgcccggggag

SEQ ID NO: 855941 - DNA, 20 bp, mouse
ggcgcggggccggcctcggg

SEQ ID NO: 855942 - DNA, 20 bp, mouse
gggagggtagactgcggggt

SEQ ID NO: 855943 - DNA, 20 bp, mouse
gaggacgcacgggcgcgcgc

SEQ ID NO: 855944 - DNA, 20 bp, mouse
gccggtggggaggcgacgcg

SEQ ID NO: 855945 - DNA, 20 bp, mouse
gggtagactgcggggttggc

SEQ ID NO: 855946 - DNA, 20 bp, mouse
gcgccagcctggccacgagt

SEQ ID NO: 855947 - DNA, 20 bp, mouse
gaggggagagcgccaggaat

SEQ ID NO: 855948 - DNA, 20 bp, mouse
gctggcgcggccgtgggtcc

SEQ ID NO: 855949 - DNA, 20 bp, mouse
ggcgcggccgtgggtcccgg

SEQ ID NO: 855950 - DNA, 20 bp, mouse
ggtcgcctcccggcccctgg

SEQ ID NO: 855951 - DNA, 20 bp, mouse
gagtgcgtcgcgaccgccag

SEQ ID NO: 855952 - DNA, 20 bp, mouse
gcgcactcccactcgtggcc

SEQ ID NO: 855953 - DNA, 20 bp, mouse
ggcgaccgccaggggccggg

SEQ ID NO: 855954 - DNA, 20 bp, mouse
ggtaaccggccgtcgcctcc

SEQ ID NO: 855955 - DNA, 20 bp, mouse
gcccaggggaggtggatgag

SEQ ID NO: 855956 - DNA, 20 bp, mouse
gcacactgaacactctacca

SEQ ID NO: 855957 - DNA, 20 bp, mouse
gatcaggccttggcaataga

SEQ ID NO: 855958 - DNA, 20 bp, mouse
gaataattgctggatctagc

SEQ ID NO: 855959 - DNA, 20 bp, mouse
gtaacaagggaacaaggcat

SEQ ID NO: 855960 - DNA, 20 bp, mouse
gttgaagtctcagactatag

SEQ ID NO: 855961 - DNA, 20 bp, mouse
gtctgttccctctattgcca

SEQ ID NO: 855962 - DNA, 20 bp, mouse
gaacaaggcataggttgtct

SEQ ID NO: 855963 - DNA, 20 bp, mouse
gctggatctagcaggtgctg

SEQ ID NO: 855964 - DNA, 20 bp, mouse
gtctcagactatagaggcct

SEQ ID NO: 855965 - DNA, 20 bp, mouse
ggtaaaattacacacttcct

SEQ ID NO: 855966 - DNA, 20 bp, mouse
gggcccgccaacagaaggac

SEQ ID NO: 855967 - DNA, 20 bp, mouse
gagggggccaagcgaggaga

SEQ ID NO: 855968 - DNA, 20 bp, mouse
gaatgtactgtgcaaggtgt

SEQ ID NO: 855969 - DNA, 20 bp, mouse
ggtgtgggctcttgattcct

SEQ ID NO: 855970 - DNA, 20 bp, mouse
gtggaggagggggccaagcg

SEQ ID NO: 855971 - DNA, 20 bp, mouse
ggctgaaagcacggggcata

SEQ ID NO: 855972 - DNA, 20 bp, mouse
gagagtgcgctgaaagcacg

SEQ ID NO: 855973 - DNA, 20 bp, mouse
gaacacgcctgtccttctgt

SEQ ID NO: 855974 - DNA, 20 bp, mouse
gcccccgtaggaagatgtgc

SEQ ID NO: 855975 - DNA, 20 bp, mouse
gagaaatttctgctgaattc

SEQ ID NO: 855976 - DNA, 20 bp, mouse
ggggcgtagcaaagggcata

SEQ ID NO: 855977 - DNA, 20 bp, mouse
gggaaggcggggcgtagcaa

SEQ ID NO: 855978 - DNA, 20 bp, mouse
gtgggccctctggggaacga

SEQ ID NO: 855979 - DNA, 20 bp, mouse
gataaggctgtctgatcata

SEQ ID NO: 855980 - DNA, 20 bp, mouse
gcccgccttccgtcatcgat

SEQ ID NO: 855981 - DNA, 20 bp, mouse
gatcatacggaaagtcttag

SEQ ID NO: 855982 - DNA, 20 bp, mouse
gcacagtaagaaaacttcac

SEQ ID NO: 855983 - DNA, 20 bp, mouse
ggtcaccaatcgatgacgga

SEQ ID NO: 855984 - DNA, 20 bp, mouse
gcaaagtcaccaatcgatga

SEQ ID NO: 855985 - DNA, 20 bp, mouse
ggtcagagtcggtctgggtt

SEQ ID NO: 855986 - DNA, 20 bp, mouse
ggaggagcatggatagtcag

SEQ ID NO: 855987 - DNA, 20 bp, mouse
gtactccgggtttactccag

SEQ ID NO: 855988 - DNA, 20 bp, mouse
gaacgtccctgattggtgaa

SEQ ID NO: 855989 - DNA, 20 bp, mouse
gtacagaacctccctaactc

SEQ ID NO: 855990 - DNA, 20 bp, mouse
gaagcgctggtgagatgggt

SEQ ID NO: 855991 - DNA, 20 bp, mouse
gcgtttaaatggaactcacc

SEQ ID NO: 855992 - DNA, 20 bp, mouse
gcaaacccctggagtaaacc

SEQ ID NO: 855993 - DNA, 20 bp, mouse
ggcgctgaaaagagttaaag

SEQ ID NO: 855994 - DNA, 20 bp, mouse
gagtaaacccggagtatatt

SEQ ID NO: 855995 - DNA, 20 bp, mouse
gcaaacgcagatcctcatga

SEQ ID NO: 855996 - DNA, 20 bp, mouse
gtggcggtgggctcttgcac

SEQ ID NO: 855997 - DNA, 20 bp, mouse
gcaatcgggcgcatagacaa

SEQ ID NO: 855998 - DNA, 20 bp, mouse
gtcaccccggcgccttcgat

SEQ ID NO: 855999 - DNA, 20 bp, mouse
ggcacaggatgccatacctc

SEQ ID NO: 856000 - DNA, 20 bp, mouse
ggggcggagatatcgtccta

SEQ ID NO: 856001 - DNA, 20 bp, mouse
ggcaagcgttcaggtggcgg

SEQ ID NO: 856002 - DNA, 20 bp, mouse
gtgaactcgatccagaccct

SEQ ID NO: 856003 - DNA, 20 bp, mouse
ggggcgcatagacaaaggga

SEQ ID NO: 856004 - DNA, 20 bp, mouse
gctgtcagtcaggtctgagc

SEQ ID NO: 856005 - DNA, 20 bp, mouse
ggggtgagaaacgcgcaatc

SEQ ID NO: 856006 - DNA, 20 bp, mouse
gtcgctaaagctttaggagg

SEQ ID NO: 856007 - DNA, 20 bp, mouse
gaataaggcggggaccaaaa

SEQ ID NO: 856008 - DNA, 20 bp, mouse
gcaaccaggcaagttgtttt

SEQ ID NO: 856009 - DNA, 20 bp, mouse
gcagtcgctaaagctttagg

SEQ ID NO: 856010 - DNA, 20 bp, mouse
gaggcgggtctgtggattga

SEQ ID NO: 856011 - DNA, 20 bp, mouse
ggctttaggaggcgggtctg

SEQ ID NO: 856012 - DNA, 20 bp, mouse
gtgacccaacacttgctcag

SEQ ID NO: 856013 - DNA, 20 bp, mouse
gatcctcactggccccacag

SEQ ID NO: 856014 - DNA, 20 bp, mouse
gtctgccctttcccactgtg

SEQ ID NO: 856015 - DNA, 20 bp, mouse
gctccagtcgctaaagcttt

SEQ ID NO: 856016 - DNA, 20 bp, mouse
gttagtgcttgcaagcgata

SEQ ID NO: 856017 - DNA, 20 bp, mouse
gtatcttcgcacgtgatggt

SEQ ID NO: 856018 - DNA, 20 bp, mouse
gtgcaagcgatagggtatat

SEQ ID NO: 856019 - DNA, 20 bp, mouse
ggggagtggcgcgtgggtgg

SEQ ID NO: 856020 - DNA, 20 bp, mouse
gtgtacaccgttataattat

SEQ ID NO: 856021 - DNA, 20 bp, mouse
gcgccactcccatattgtta

SEQ ID NO: 856022 - DNA, 20 bp, mouse
gacaatatgggagtggcgcg

SEQ ID NO: 856023 - DNA, 20 bp, mouse
gaaccacgtgacgatctaag

SEQ ID NO: 856024 - DNA, 20 bp, mouse
gggacatagccataacaata

SEQ ID NO: 856025 - DNA, 20 bp, mouse
gtgacattccacatgatcca

SEQ ID NO: 856026 - DNA, 20 bp, mouse
gcctcagtgtggtggacgag

SEQ ID NO: 856027 - DNA, 20 bp, mouse
ggggaacgcggcagacaaga

SEQ ID NO: 856028 - DNA, 20 bp, mouse
ggggaaatgtagtcagtccg

SEQ ID NO: 856029 - DNA, 20 bp, mouse
ggggctccctggcttctcgc

SEQ ID NO: 856030 - DNA, 20 bp, mouse
gtagtcagtccgagggaacg

SEQ ID NO: 856031 - DNA, 20 bp, mouse
gaaggggcggagaactggta

SEQ ID NO: 856032 - DNA, 20 bp, mouse
gatagactgcatcaggaaag

SEQ ID NO: 856033 - DNA, 20 bp, mouse
ggagaagccagggagccctc

SEQ ID NO: 856034 - DNA, 20 bp, mouse
gcagtagtggaagctgatat

SEQ ID NO: 856035 - DNA, 20 bp, mouse
gcaagatggctcccgatggg

SEQ ID NO: 856036 - DNA, 20 bp, mouse
gaggaagcctaagactgaga

SEQ ID NO: 856037 - DNA, 20 bp, mouse
ggggtctaccaaaatgttta

SEQ ID NO: 856038 - DNA, 20 bp, mouse
gagagcagcccgaaggatcc

SEQ ID NO: 856039 - DNA, 20 bp, mouse
ggaactgaatccccggagca

SEQ ID NO: 856040 - DNA, 20 bp, mouse
gaaacaggataaaagcaggg

SEQ ID NO: 856041 - DNA, 20 bp, mouse
ggccagagagcgctaggacg

SEQ ID NO: 856042 - DNA, 20 bp, mouse
gtgccagtatccctgctccg

SEQ ID NO: 856043 - DNA, 20 bp, mouse
ggtctaggagagcagcccga

SEQ ID NO: 856044 - DNA, 20 bp, mouse
gatccccggagcagggatac

SEQ ID NO: 856045 - DNA, 20 bp, mouse
gcagaaacaggataaaagca

SEQ ID NO: 856046 - DNA, 20 bp, mouse
gatcgcgggcggggcccctc

SEQ ID NO: 856047 - DNA, 20 bp, mouse
gcctctggaacgcccgcgat

SEQ ID NO: 856048 - DNA, 20 bp, mouse
gcgcgcctcgggagccggga

SEQ ID NO: 856049 - DNA, 20 bp, mouse
gaaaagggtccgggaaggcg

SEQ ID NO: 856050 - DNA, 20 bp, mouse
ggtcgccaggaccagatcgc

SEQ ID NO: 856051 - DNA, 20 bp, mouse
gcccgcccgcgatctggtcc

SEQ ID NO: 856052 - DNA, 20 bp, mouse
ggcctcgggggaaaagggtc

SEQ ID NO: 856053 - DNA, 20 bp, mouse
gggcgcgcgcctggcgctgt

SEQ ID NO: 856054 - DNA, 20 bp, mouse
ggcggggcctcgggggaaaa

SEQ ID NO: 856055 - DNA, 20 bp, mouse
ggtccgggaaggcggggctt

SEQ ID NO: 856056 - DNA, 20 bp, mouse
gacagcctgagcgacgatag

SEQ ID NO: 856057 - DNA, 20 bp, mouse
gagtactgcgttgggtgcgg

SEQ ID NO: 856058 - DNA, 20 bp, mouse
gtgtgactggcagttccgcc

SEQ ID NO: 856059 - DNA, 20 bp, mouse
gactgcgttgggtgcggtgg

SEQ ID NO: 856060 - DNA, 20 bp, mouse
gcctgcaagtcagacaatga

SEQ ID NO: 856061 - DNA, 20 bp, mouse
gcgatagtggatcctcttcc

SEQ ID NO: 856062 - DNA, 20 bp, mouse
gggatccactatcgtcgctc

SEQ ID NO: 856063 - DNA, 20 bp, mouse
gagacaatgagggttgttta

SEQ ID NO: 856064 - DNA, 20 bp, mouse
gacaacgactcggtttcttc

SEQ ID NO: 856065 - DNA, 20 bp, mouse
gaaaaggacctgccccggac

SEQ ID NO: 856066 - DNA, 20 bp, mouse
gacacagaggcacagactga

SEQ ID NO: 856067 - DNA, 20 bp, mouse
gcaaagaggaaggtgcccta

SEQ ID NO: 856068 - DNA, 20 bp, mouse
gagtccgccctgagagcctt

SEQ ID NO: 856069 - DNA, 20 bp, mouse
gaaggtgccctaaggctctc

SEQ ID NO: 856070 - DNA, 20 bp, mouse
gagcccctaacactaatgtc

SEQ ID NO: 856071 - DNA, 20 bp, mouse
ggatcccgacattagtgtta

SEQ ID NO: 856072 - DNA, 20 bp, mouse
gccgctagtcgcccaatcaa

SEQ ID NO: 856073 - DNA, 20 bp, mouse
ggctctgtctggaaagcatg

SEQ ID NO: 856074 - DNA, 20 bp, mouse
gacactaatgtcgggatcaa

SEQ ID NO: 856075 - DNA, 20 bp, mouse
gcgcgcgtgcgggggtggga

SEQ ID NO: 856076 - DNA, 20 bp, mouse
ggggctggactgttgaacca

SEQ ID NO: 856077 - DNA, 20 bp, mouse
gacccggagccaagcggcct

SEQ ID NO: 856078 - DNA, 20 bp, mouse
gggcccacactcaggagtgt

SEQ ID NO: 856079 - DNA, 20 bp, mouse
gtggcgccagggttcggagt

SEQ ID NO: 856080 - DNA, 20 bp, mouse
ggagtcggcaagtttggggc

SEQ ID NO: 856081 - DNA, 20 bp, mouse
gttcggagtcggcaagtttg

SEQ ID NO: 856082 - DNA, 20 bp, mouse
gacatcctgcagcccacggg

SEQ ID NO: 856083 - DNA, 20 bp, mouse
gcgcccacactcctgagtgt

SEQ ID NO: 856084 - DNA, 20 bp, mouse
ggcgcagatgttcacagcca

SEQ ID NO: 856085 - DNA, 20 bp, mouse
ggacaccccgcacactctag

SEQ ID NO: 856086 - DNA, 20 bp, mouse
gcccaccactcagttaagga

SEQ ID NO: 856087 - DNA, 20 bp, mouse
gaatagctaggcttacagtt

SEQ ID NO: 856088 - DNA, 20 bp, mouse
gatcccccaccactcagtta

SEQ ID NO: 856089 - DNA, 20 bp, mouse
gcactcagttaaggaaggta

SEQ ID NO: 856090 - DNA, 20 bp, mouse
gctagctattcaagggactg

SEQ ID NO: 856091 - DNA, 20 bp, mouse
gagagaccccatagtaagtg

SEQ ID NO: 856092 - DNA, 20 bp, mouse
gtggtgggggattgttgttt

SEQ ID NO: 856093 - DNA, 20 bp, mouse
ggagaaccacacttactatg

SEQ ID NO: 856094 - DNA, 20 bp, mouse
gaaccctagcccaccaaggt

SEQ ID NO: 856095 - DNA, 20 bp, mouse
gaaacatacaaaaagagcta

SEQ ID NO: 856096 - DNA, 20 bp, mouse
gtcccggatcggatcctcag

SEQ ID NO: 856097 - DNA, 20 bp, mouse
gatggagcgagtgacacttg

SEQ ID NO: 856098 - DNA, 20 bp, mouse
gtccactgaggatccgatcc

SEQ ID NO: 856099 - DNA, 20 bp, mouse
ggaagtgcgtcacccggtag

SEQ ID NO: 856100 - DNA, 20 bp, mouse
ggcaggccaaaacatctcca

SEQ ID NO: 856101 - DNA, 20 bp, mouse
gccgcccctacagacgacac

SEQ ID NO: 856102 - DNA, 20 bp, mouse
gccatgctgatgtcccggat

SEQ ID NO: 856103 - DNA, 20 bp, mouse
gcgaacccgtgtcgtctgta

SEQ ID NO: 856104 - DNA, 20 bp, mouse
gtgcgtcacccggtagaggg

SEQ ID NO: 856105 - DNA, 20 bp, mouse
gcgaaacattaacagagcgg

SEQ ID NO: 856106 - DNA, 20 bp, mouse
gatctgttgaaactagagaa

SEQ ID NO: 856107 - DNA, 20 bp, mouse
gggctggaaagaggttgttc

SEQ ID NO: 856108 - DNA, 20 bp, mouse
gacttcaagccttggatcct

SEQ ID NO: 856109 - DNA, 20 bp, mouse
ggactgggaacgactggata

SEQ ID NO: 856110 - DNA, 20 bp, mouse
gcggacgattagttttctaa

SEQ ID NO: 856111 - DNA, 20 bp, mouse
gagacaaggctgttaggact

SEQ ID NO: 856112 - DNA, 20 bp, mouse
gggaatttcccaaggatcca

SEQ ID NO: 856113 - DNA, 20 bp, mouse
ggtagggcactgagatgatc

SEQ ID NO: 856114 - DNA, 20 bp, mouse
gcgagcaagtgatccagctc

SEQ ID NO: 856115 - DNA, 20 bp, mouse
gagtttcggctctgtggtgg

SEQ ID NO: 856116 - DNA, 20 bp, mouse
gaagtcgccgaggcaaggat

SEQ ID NO: 856117 - DNA, 20 bp, mouse
gtcgccgaggcaaggatggg

SEQ ID NO: 856118 - DNA, 20 bp, mouse
ggccgtggagggtcagttta

SEQ ID NO: 856119 - DNA, 20 bp, mouse
ggggtgacggcggccgtgga

SEQ ID NO: 856120 - DNA, 20 bp, mouse
gtaggcccgaagcctaggac

SEQ ID NO: 856121 - DNA, 20 bp, mouse
gcttcacgccaggacggaag

SEQ ID NO: 856122 - DNA, 20 bp, mouse
gcgtgaagcccgggagattt

SEQ ID NO: 856123 - DNA, 20 bp, mouse
gcgtgagacccgcccgtcct

SEQ ID NO: 856124 - DNA, 20 bp, mouse
gcctagacgtaaagatgaac

SEQ ID NO: 856125 - DNA, 20 bp, mouse
gtacgtctaggaagtcgccg

SEQ ID NO: 856126 - DNA, 20 bp, mouse
ggactacccggaaccaaaga

SEQ ID NO: 856127 - DNA, 20 bp, mouse
ggggttcctagaatcttatg

SEQ ID NO: 856128 - DNA, 20 bp, mouse
gggagcaagaagctacttta

SEQ ID NO: 856129 - DNA, 20 bp, mouse
gcgcatggattgtatgtaac

SEQ ID NO: 856130 - DNA, 20 bp, mouse
gctgccccccataagattct

SEQ ID NO: 856131 - DNA, 20 bp, mouse
gtaatacatattaccgttaa

SEQ ID NO: 856132 - DNA, 20 bp, mouse
ggcaaagaatttaaagcgca

SEQ ID NO: 856133 - DNA, 20 bp, mouse
ggagtagcccccatctcttt

SEQ ID NO: 856134 - DNA, 20 bp, mouse
gggcacaccacaaactcttt

SEQ ID NO: 856135 - DNA, 20 bp, mouse
gagagatgggggctactcac

SEQ ID NO: 856136 - DNA, 20 bp, mouse
gagcactgtgaacggtagga

SEQ ID NO: 856137 - DNA, 20 bp, mouse
gtggaagcactgtgaacggt

SEQ ID NO: 856138 - DNA, 20 bp, mouse
gggtctggaagcactgtgaa

SEQ ID NO: 856139 - DNA, 20 bp, mouse
gtgctgtacagcccaccact

SEQ ID NO: 856140 - DNA, 20 bp, mouse
gcagtgacagaagtcggtct

SEQ ID NO: 856141 - DNA, 20 bp, mouse
gcaggacttttaaattgcgt

SEQ ID NO: 856142 - DNA, 20 bp, mouse
gttgggcaggtgcatcacat

SEQ ID NO: 856143 - DNA, 20 bp, mouse
gcatactcgcctcctgtggc

SEQ ID NO: 856144 - DNA, 20 bp, mouse
gagatcatactcgcctcctg

SEQ ID NO: 856145 - DNA, 20 bp, mouse
gatgtgcacacaagttctct

SEQ ID NO: 856146 - DNA, 20 bp, mouse
ggacaaggagctgtacccgt

SEQ ID NO: 856147 - DNA, 20 bp, mouse
gtcccagggtgtcctgaccc

SEQ ID NO: 856148 - DNA, 20 bp, mouse
gggactcaggacaggagcac

SEQ ID NO: 856149 - DNA, 20 bp, mouse
gaaagcttgtggcacgcttg

SEQ ID NO: 856150 - DNA, 20 bp, mouse
gccacaagctttccagtctt

SEQ ID NO: 856151 - DNA, 20 bp, mouse
gtgtggccttagaagcgtgg

SEQ ID NO: 856152 - DNA, 20 bp, mouse
ggtcagcggaggtgaatccc

SEQ ID NO: 856153 - DNA, 20 bp, mouse
gcatgctttggaaggggaca

SEQ ID NO: 856154 - DNA, 20 bp, mouse
gggttagttcccacagttat

SEQ ID NO: 856155 - DNA, 20 bp, mouse
gaatactgacccataactgt

SEQ ID NO: 856156 - DNA, 20 bp, mouse
gcacgggaggggaacagcca

SEQ ID NO: 856157 - DNA, 20 bp, mouse
gggtggcggaggaacgggta

SEQ ID NO: 856158 - DNA, 20 bp, mouse
gccggcactagacacgggag

SEQ ID NO: 856159 - DNA, 20 bp, mouse
gcgcccaccggaagcagcct

SEQ ID NO: 856160 - DNA, 20 bp, mouse
gagccaaggctgcttccggt

SEQ ID NO: 856161 - DNA, 20 bp, mouse
gtaacgggacgttcagagat

SEQ ID NO: 856162 - DNA, 20 bp, mouse
gcaagcgccggcgtggagga

SEQ ID NO: 856163 - DNA, 20 bp, mouse
gaggatggtggcggaggaac

SEQ ID NO: 856164 - DNA, 20 bp, mouse
ggctgcttccggtgggcgaa

SEQ ID NO: 856165 - DNA, 20 bp, mouse
gaagaagaagcgggcgcaat

SEQ ID NO: 856166 - DNA, 20 bp, mouse
ggaatcccacacttcggctt

SEQ ID NO: 856167 - DNA, 20 bp, mouse
gcacggttctagaacctgat

SEQ ID NO: 856168 - DNA, 20 bp, mouse
gcacagtgacgacttggtga

SEQ ID NO: 856169 - DNA, 20 bp, mouse
gtgcttagaagcaaggaggg

SEQ ID NO: 856170 - DNA, 20 bp, mouse
ggcttccaaagccgaagtgt

SEQ ID NO: 856171 - DNA, 20 bp, mouse
gttggaagctagtgtcactc

SEQ ID NO: 856172 - DNA, 20 bp, mouse
gggtgtgcacagtgacgact

SEQ ID NO: 856173 - DNA, 20 bp, mouse
ggattgctgcaatgagcact

SEQ ID NO: 856174 - DNA, 20 bp, mouse
ggttctgcttagaagcaagg

SEQ ID NO: 856175 - DNA, 20 bp, mouse
gactggagagcggcaagagg

SEQ ID NO: 856176 - DNA, 20 bp, mouse
gccggccgcaatcgcgaccc

SEQ ID NO: 856177 - DNA, 20 bp, mouse
gctggcggggcccgggacaa

SEQ ID NO: 856178 - DNA, 20 bp, mouse
gggccagcactcatagcgaa

SEQ ID NO: 856179 - DNA, 20 bp, mouse
ggaagcgccagccgccggta

SEQ ID NO: 856180 - DNA, 20 bp, mouse
gcgccggtacggccacacgg

SEQ ID NO: 856181 - DNA, 20 bp, mouse
gacaacgggtctcctcagcc

SEQ ID NO: 856182 - DNA, 20 bp, mouse
gccgccgccagcggttgctg

SEQ ID NO: 856183 - DNA, 20 bp, mouse
gtcagcctgggtcgcgattg

SEQ ID NO: 856184 - DNA, 20 bp, mouse
gtgaggagacccgttgtccc

SEQ ID NO: 856185 - DNA, 20 bp, mouse
gccggcggctggcgcttctg

SEQ ID NO: 856186 - DNA, 20 bp, mouse
gcaggccgcagctcgagcgg

SEQ ID NO: 856187 - DNA, 20 bp, mouse
gctaatcactcaaggattgg

SEQ ID NO: 856188 - DNA, 20 bp, mouse
gcgcccctccgctcgagctg

SEQ ID NO: 856189 - DNA, 20 bp, mouse
gttgacagagagatacttac

SEQ ID NO: 856190 - DNA, 20 bp, mouse
gttccactctgatagacgaa

SEQ ID NO: 856191 - DNA, 20 bp, mouse
ggctcgagctgcggcctgat

SEQ ID NO: 856192 - DNA, 20 bp, mouse
gagagtggaattgtccaatc

SEQ ID NO: 856193 - DNA, 20 bp, mouse
gtccctaatcactcaaggat

SEQ ID NO: 856194 - DNA, 20 bp, mouse
gaacccttcgtctatcagag

SEQ ID NO: 856195 - DNA, 20 bp, mouse
gtggaggcaagcagatccgg

SEQ ID NO: 856196 - DNA, 20 bp, mouse
gagggccgctgtcccctgat

SEQ ID NO: 856197 - DNA, 20 bp, mouse
ggctcctcttgcagttcctt

SEQ ID NO: 856198 - DNA, 20 bp, mouse
gggccagcaggtgtcaacat

SEQ ID NO: 856199 - DNA, 20 bp, mouse
gtgtcccctgatgggaggag

SEQ ID NO: 856200 - DNA, 20 bp, mouse
gccaccgcaacactaaacaa

SEQ ID NO: 856201 - DNA, 20 bp, mouse
gagtgcttggagctgtgtgg

SEQ ID NO: 856202 - DNA, 20 bp, mouse
ggtcctggaatcattcagta

SEQ ID NO: 856203 - DNA, 20 bp, mouse
ggcctggcaatggtgagcga

SEQ ID NO: 856204 - DNA, 20 bp, mouse
gagtgaacgcggggacgtcg

SEQ ID NO: 856205 - DNA, 20 bp, mouse
gaacctatgttgacacctgc

SEQ ID NO: 856206 - DNA, 20 bp, mouse
gggaactgcttcatcattca

SEQ ID NO: 856207 - DNA, 20 bp, mouse
gctacgagggcctgagtgac

SEQ ID NO: 856208 - DNA, 20 bp, mouse
ggggccgctgtccccggatg

SEQ ID NO: 856209 - DNA, 20 bp, mouse
gctgccctcagggccctgat

SEQ ID NO: 856210 - DNA, 20 bp, mouse
gagaatctgcagcatggcgg

SEQ ID NO: 856211 - DNA, 20 bp, mouse
gctagccaatcagaaccttc

SEQ ID NO: 856212 - DNA, 20 bp, mouse
gccgctgtccccggatgggg

SEQ ID NO: 856213 - DNA, 20 bp, mouse
gggctagcactgccctacga

SEQ ID NO: 856214 - DNA, 20 bp, mouse
ggaccgctcctccccatccg

SEQ ID NO: 856215 - DNA, 20 bp, mouse
gcgcgtggtcccgtgagctg

SEQ ID NO: 856216 - DNA, 20 bp, mouse
gcgtgctagaacatccgttg

SEQ ID NO: 856217 - DNA, 20 bp, mouse
gaaaggagaggtgtcagcac

SEQ ID NO: 856218 - DNA, 20 bp, mouse
gccctactgacagcggagga

SEQ ID NO: 856219 - DNA, 20 bp, mouse
ggctgcttgtgacgtcacag

SEQ ID NO: 856220 - DNA, 20 bp, mouse
gcatccgttgaggctttgat

SEQ ID NO: 856221 - DNA, 20 bp, mouse
gaaaagttccggttgtaaaa

SEQ ID NO: 856222 - DNA, 20 bp, mouse
gcaggctgctttaaaagttc

SEQ ID NO: 856223 - DNA, 20 bp, mouse
gccgttgaggctttgatagg

SEQ ID NO: 856224 - DNA, 20 bp, mouse
gaggggttattagttgtatc

SEQ ID NO: 856225 - DNA, 20 bp, mouse
gagcacgtccgttttacaac

SEQ ID NO: 856226 - DNA, 20 bp, mouse
gagacagggctagaacgcag

SEQ ID NO: 856227 - DNA, 20 bp, mouse
ggctccaggacctgagccaa

SEQ ID NO: 856228 - DNA, 20 bp, mouse
gtcctggagcgctagtgaca

SEQ ID NO: 856229 - DNA, 20 bp, mouse
gacctgagccaagggctcgc

SEQ ID NO: 856230 - DNA, 20 bp, mouse
ggagcccttggctcaggtcc

SEQ ID NO: 856231 - DNA, 20 bp, mouse
ggccagcgagcccttggctc

SEQ ID NO: 856232 - DNA, 20 bp, mouse
ggcctatccggagaaaggtt

SEQ ID NO: 856233 - DNA, 20 bp, mouse
gcgctggcctatccggagaa

SEQ ID NO: 856234 - DNA, 20 bp, mouse
gtgcacacagtcacccagac

SEQ ID NO: 856235 - DNA, 20 bp, mouse
gtaggctcgctggcctatca

SEQ ID NO: 856236 - DNA, 20 bp, mouse
gaggcgtgcacgtgactcac

SEQ ID NO: 856237 - DNA, 20 bp, mouse
gagggcgggcacagaagcgg

SEQ ID NO: 856238 - DNA, 20 bp, mouse
gtggggtctaaactggaggt

SEQ ID NO: 856239 - DNA, 20 bp, mouse
gcatcctctcgagtgtactg

SEQ ID NO: 856240 - DNA, 20 bp, mouse
gaacgccagaagtagagttt

SEQ ID NO: 856241 - DNA, 20 bp, mouse
ggcgccacagtacactcgag

SEQ ID NO: 856242 - DNA, 20 bp, mouse
gtctggcgttacgtgtgaag

SEQ ID NO: 856243 - DNA, 20 bp, mouse
gaacgtaaggcttgatactt

SEQ ID NO: 856244 - DNA, 20 bp, mouse
gagggcaatagtggcgaggt

SEQ ID NO: 856245 - DNA, 20 bp, mouse
gtgatacttggggtctaaac

SEQ ID NO: 856246 - DNA, 20 bp, mouse
gctaccaggggaacaaactc

SEQ ID NO: 856247 - DNA, 20 bp, mouse
gcgcgctagctgtccaatca

SEQ ID NO: 856248 - DNA, 20 bp, mouse
gacactccggcgtccctgat

SEQ ID NO: 856249 - DNA, 20 bp, mouse
gaccaatccgaggagtgtcc

SEQ ID NO: 856250 - DNA, 20 bp, mouse
gctcgggcaggaccaatccg

SEQ ID NO: 856251 - DNA, 20 bp, mouse
ggagggacatgagtaggccc

SEQ ID NO: 856252 - DNA, 20 bp, mouse
gctgaatgagggacatgagt

SEQ ID NO: 856253 - DNA, 20 bp, mouse
ggggtctttcagcttcatct

SEQ ID NO: 856254 - DNA, 20 bp, mouse
gagcggacattcaggcgagt

SEQ ID NO: 856255 - DNA, 20 bp, mouse
gggacgccggagtgtatgtt

SEQ ID NO: 856256 - DNA, 20 bp, mouse
ggagtcaagagtgccttaca

SEQ ID NO: 856257 - DNA, 20 bp, mouse
gtgactggcagtccgaatcc

SEQ ID NO: 856258 - DNA, 20 bp, mouse
gggactgccagtcagaacgg

SEQ ID NO: 856259 - DNA, 20 bp, mouse
gctaacattctgtgcccagg

SEQ ID NO: 856260 - DNA, 20 bp, mouse
gtccgaatccaggctctgat

SEQ ID NO: 856261 - DNA, 20 bp, mouse
gaagagatcgggaatgtaaa

SEQ ID NO: 856262 - DNA, 20 bp, mouse
gtgcccgcctccgttctgac

SEQ ID NO: 856263 - DNA, 20 bp, mouse
gagggccgctgtgggaagca

SEQ ID NO: 856264 - DNA, 20 bp, mouse
gtgtaagcagtatggactga

SEQ ID NO: 856265 - DNA, 20 bp, mouse
ggcagggctgtagaagttca

SEQ ID NO: 856266 - DNA, 20 bp, mouse
gtagaactggacacagttca

SEQ ID NO: 856267 - DNA, 20 bp, mouse
gggcaccttacataaacatt

SEQ ID NO: 856268 - DNA, 20 bp, mouse
ggtctccttgtttcctaagt

SEQ ID NO: 856269 - DNA, 20 bp, mouse
ggtcacctacttaggaaaca

SEQ ID NO: 856270 - DNA, 20 bp, mouse
ggtaaactccacggaaatta

SEQ ID NO: 856271 - DNA, 20 bp, mouse
gaatgtagtgtcacctactt

SEQ ID NO: 856272 - DNA, 20 bp, mouse
gcgagccgaatgtttatgta

SEQ ID NO: 856273 - DNA, 20 bp, mouse
gcagtgaaaatccggaaaag

SEQ ID NO: 856274 - DNA, 20 bp, mouse
gaaatgattaacgcatggtc

SEQ ID NO: 856275 - DNA, 20 bp, mouse
gttgctctttgtcctctgtg

SEQ ID NO: 856276 - DNA, 20 bp, mouse
gcactcggctcgttagaact

SEQ ID NO: 856277 - DNA, 20 bp, mouse
gtagaactgggctcagttcg

SEQ ID NO: 856278 - DNA, 20 bp, mouse
gtaactaggcgacactaact

SEQ ID NO: 856279 - DNA, 20 bp, mouse
ggcctccatgcttcttaact

SEQ ID NO: 856280 - DNA, 20 bp, mouse
gtctgtggtccagcttaaag

SEQ ID NO: 856281 - DNA, 20 bp, mouse
ggtccagcttaaaggggcag

SEQ ID NO: 856282 - DNA, 20 bp, mouse
ggtcgcctagttaagaagca

SEQ ID NO: 856283 - DNA, 20 bp, mouse
gttgtactacaaaatggtcc

SEQ ID NO: 856284 - DNA, 20 bp, mouse
gtaagagatagagacactcc

SEQ ID NO: 856285 - DNA, 20 bp, mouse
gcactgacaaatattcacac

SEQ ID NO: 856286 - DNA, 20 bp, mouse
ggcccagagcgggtaagact

SEQ ID NO: 856287 - DNA, 20 bp, mouse
gaccctgtatggtgcagagt

SEQ ID NO: 856288 - DNA, 20 bp, mouse
gcactcctacccaccctgta

SEQ ID NO: 856289 - DNA, 20 bp, mouse
ggtcccactctgcaccatac

SEQ ID NO: 856290 - DNA, 20 bp, mouse
gacagaaacctgaaagctgg

SEQ ID NO: 856291 - DNA, 20 bp, mouse
gaatggtaatactactaaag

SEQ ID NO: 856292 - DNA, 20 bp, mouse
gcgcgtgcgcgcgagccacc

SEQ ID NO: 856293 - DNA, 20 bp, mouse
gggagtgtcacagtgccttc

SEQ ID NO: 856294 - DNA, 20 bp, mouse
gggacaactcagattttcag

SEQ ID NO: 856295 - DNA, 20 bp, mouse
ggcttcattcataattacaa

SEQ ID NO: 856296 - DNA, 20 bp, mouse
gcgaccccaaactccctcag

SEQ ID NO: 856297 - DNA, 20 bp, mouse
ggagaacagagtcgcaacta

SEQ ID NO: 856298 - DNA, 20 bp, mouse
gaaactgtacggtcagctca

SEQ ID NO: 856299 - DNA, 20 bp, mouse
gcacaaggggctctgtgtat

SEQ ID NO: 856300 - DNA, 20 bp, mouse
gggtgagcatcggggatgcg

SEQ ID NO: 856301 - DNA, 20 bp, mouse
gtccctcggtacgggaacca

SEQ ID NO: 856302 - DNA, 20 bp, mouse
gtccaccctggagccgcgtg

SEQ ID NO: 856303 - DNA, 20 bp, mouse
gcagtccgctgagggagttt

SEQ ID NO: 856304 - DNA, 20 bp, mouse
gcaggcgagtccctcggtac

SEQ ID NO: 856305 - DNA, 20 bp, mouse
ggcgacctgactctgatact

SEQ ID NO: 856306 - DNA, 20 bp, mouse
gagcacgcgatcctgtgggg

SEQ ID NO: 856307 - DNA, 20 bp, mouse
gggagaacccctcaaatcgg

SEQ ID NO: 856308 - DNA, 20 bp, mouse
gagcgagcacgcgatcctgt

SEQ ID NO: 856309 - DNA, 20 bp, mouse
gcgatcctgtggggcggcgg

SEQ ID NO: 856310 - DNA, 20 bp, mouse
gacacacggagtcatcgcgg

SEQ ID NO: 856311 - DNA, 20 bp, mouse
gcctcccgccgccgccccac

SEQ ID NO: 856312 - DNA, 20 bp, mouse
gttgaggggttctccgattg

SEQ ID NO: 856313 - DNA, 20 bp, mouse
gatcggagaacccctcaaat

SEQ ID NO: 856314 - DNA, 20 bp, mouse
gtgccacgtcacccgggcgg

SEQ ID NO: 856315 - DNA, 20 bp, mouse
ggcgggaggagcgcgctggg

SEQ ID NO: 856316 - DNA, 20 bp, mouse
gaggaggcaggacctctgca

SEQ ID NO: 856317 - DNA, 20 bp, mouse
gctcgcgcctgcccatccac

SEQ ID NO: 856318 - DNA, 20 bp, mouse
gcgggcacgcgaggatagct

SEQ ID NO: 856319 - DNA, 20 bp, mouse
gtccgagtgcagtgggtagg

SEQ ID NO: 856320 - DNA, 20 bp, mouse
gcagccccccactaggaggc

SEQ ID NO: 856321 - DNA, 20 bp, mouse
gggtcctgcctcctagtggg

SEQ ID NO: 856322 - DNA, 20 bp, mouse
ggcagcgggcgctagagggg

SEQ ID NO: 856323 - DNA, 20 bp, mouse
gaaactgcagcgggcgctag

SEQ ID NO: 856324 - DNA, 20 bp, mouse
gcagtaagagcacaagaagg

SEQ ID NO: 856325 - DNA, 20 bp, mouse
ggagggaaagggaacgggat

SEQ ID NO: 856326 - DNA, 20 bp, mouse
gagaaatcatgggaaactag

SEQ ID NO: 856327 - DNA, 20 bp, mouse
gcatgggaaactagaggcag

SEQ ID NO: 856328 - DNA, 20 bp, mouse
gacagcgcgggatagtcgtg

SEQ ID NO: 856329 - DNA, 20 bp, mouse
gggctgggagcgtctatctg

SEQ ID NO: 856330 - DNA, 20 bp, mouse
gcaggcgtcgcgacctaacc

SEQ ID NO: 856331 - DNA, 20 bp, mouse
ggcagggccaacttcgccga

SEQ ID NO: 856332 - DNA, 20 bp, mouse
gagagtgccctcggcgaagt

SEQ ID NO: 856333 - DNA, 20 bp, mouse
ggggacccctagcctgtaat

SEQ ID NO: 856334 - DNA, 20 bp, mouse
gaacgagtccctaacctcct

SEQ ID NO: 856335 - DNA, 20 bp, mouse
ggtcgtgaggcgcacgcgca

SEQ ID NO: 856336 - DNA, 20 bp, mouse
ggaagtgtcccgggttcatg

SEQ ID NO: 856337 - DNA, 20 bp, mouse
gcatgcgcagcgctgcagga

SEQ ID NO: 856338 - DNA, 20 bp, mouse
gtgggaacggggcgcaaaag

SEQ ID NO: 856339 - DNA, 20 bp, mouse
ggagaccagacgcctaagtg

SEQ ID NO: 856340 - DNA, 20 bp, mouse
gagcaggcgtggctggggcg

SEQ ID NO: 856341 - DNA, 20 bp, mouse
gagtactgaagcaacaagag

SEQ ID NO: 856342 - DNA, 20 bp, mouse
gccccccagggtagacatca

SEQ ID NO: 856343 - DNA, 20 bp, mouse
ggtctcactccccatgaacc

SEQ ID NO: 856344 - DNA, 20 bp, mouse
gaatgatatgggatcaacag

SEQ ID NO: 856345 - DNA, 20 bp, mouse
ggacacttccattttctgtc

SEQ ID NO: 856346 - DNA, 20 bp, mouse
gcctcagtggctgcactctc

SEQ ID NO: 856347 - DNA, 20 bp, mouse
gccccggaatggcaaagctt

SEQ ID NO: 856348 - DNA, 20 bp, mouse
gctctggggactatattccc

SEQ ID NO: 856349 - DNA, 20 bp, mouse
gtaactaaggggattccttt

SEQ ID NO: 856350 - DNA, 20 bp, mouse
gggaactcccccagtagtcc

SEQ ID NO: 856351 - DNA, 20 bp, mouse
ggggactatattccccggaa

SEQ ID NO: 856352 - DNA, 20 bp, mouse
gaattcccagaattcctcag

SEQ ID NO: 856353 - DNA, 20 bp, mouse
gcaccgaagctttgccattc

SEQ ID NO: 856354 - DNA, 20 bp, mouse
gagaagagcgacctaccaaa

SEQ ID NO: 856355 - DNA, 20 bp, mouse
gccaacgccagtagtggtca

SEQ ID NO: 856356 - DNA, 20 bp, mouse
gctacctcaggtcaagagca

SEQ ID NO: 856357 - DNA, 20 bp, mouse
gagtccttgctcttgacctg

SEQ ID NO: 856358 - DNA, 20 bp, mouse
gtccgactgcaggttctcat

SEQ ID NO: 856359 - DNA, 20 bp, mouse
gggaaagtgcctaccacgca

SEQ ID NO: 856360 - DNA, 20 bp, mouse
gaaactccaacgccaaagga

SEQ ID NO: 856361 - DNA, 20 bp, mouse
gatagaagtgaagctacctc

SEQ ID NO: 856362 - DNA, 20 bp, mouse
gttgtgtcaaggaggaaaag

SEQ ID NO: 856363 - DNA, 20 bp, mouse
gtgcagtcggagcgtcatcg

SEQ ID NO: 856364 - DNA, 20 bp, mouse
gagtcggagcgtcatcgggg

SEQ ID NO: 856365 - DNA, 20 bp, mouse
ggtgacaagagtccctcctt

SEQ ID NO: 856366 - DNA, 20 bp, mouse
gcagatgggtaggctatcgg

SEQ ID NO: 856367 - DNA, 20 bp, mouse
ggcagcggcaggtggagtag

SEQ ID NO: 856368 - DNA, 20 bp, mouse
ggtcaagacctggtgatcac

SEQ ID NO: 856369 - DNA, 20 bp, mouse
ggcccattactcaacttgca

SEQ ID NO: 856370 - DNA, 20 bp, mouse
ggactggcaggtccgcgtag

SEQ ID NO: 856371 - DNA, 20 bp, mouse
ggccaatcagagcctctacg

SEQ ID NO: 856372 - DNA, 20 bp, mouse
gcttgattccaggagtaaga

SEQ ID NO: 856373 - DNA, 20 bp, mouse
gtgtgcacccttccgcttat

SEQ ID NO: 856374 - DNA, 20 bp, mouse
gggcactggacttgaagcta

SEQ ID NO: 856375 - DNA, 20 bp, mouse
gtacagagggagggaagctc

SEQ ID NO: 856376 - DNA, 20 bp, mouse
gtgactgaggccgttcgcgc

SEQ ID NO: 856377 - DNA, 20 bp, mouse
gttagcgtacagaggttcat

SEQ ID NO: 856378 - DNA, 20 bp, mouse
gcgttcgcgctggcaaattc

SEQ ID NO: 856379 - DNA, 20 bp, mouse
gggaaataacaaaggctcat

SEQ ID NO: 856380 - DNA, 20 bp, mouse
gcctcagtcacgtgttacag

SEQ ID NO: 856381 - DNA, 20 bp, mouse
gccggaactacgtaagttcc

SEQ ID NO: 856382 - DNA, 20 bp, mouse
gcggggcagaggaggcttcc

SEQ ID NO: 856383 - DNA, 20 bp, mouse
gtgggtcagtaaaattcccc

SEQ ID NO: 856384 - DNA, 20 bp, mouse
gcgtagttccggggcagagg

SEQ ID NO: 856385 - DNA, 20 bp, mouse
gtcgcgctggcaaattccgg

SEQ ID NO: 856386 - DNA, 20 bp, mouse
gtgatccaatgccctcatgt

SEQ ID NO: 856387 - DNA, 20 bp, mouse
gtcttcagactcccacatga

SEQ ID NO: 856388 - DNA, 20 bp, mouse
ggactcccacatgagggcat

SEQ ID NO: 856389 - DNA, 20 bp, mouse
ggttgctgggaattaaatgc

SEQ ID NO: 856390 - DNA, 20 bp, mouse
gaaactgattgttcatgcag

SEQ ID NO: 856391 - DNA, 20 bp, mouse
ggagagatgcctcagcactt

SEQ ID NO: 856392 - DNA, 20 bp, mouse
gtaatggacattttttaaaa

SEQ ID NO: 856393 - DNA, 20 bp, mouse
ggtgagtaaataagttttac

SEQ ID NO: 856394 - DNA, 20 bp, mouse
gggcattggatcactattac

SEQ ID NO: 856395 - DNA, 20 bp, mouse
gtcgggcatctattcttcat

SEQ ID NO: 856396 - DNA, 20 bp, mouse
gcgaggagaagcagaaccgg

SEQ ID NO: 856397 - DNA, 20 bp, mouse
gtctcaaaagggtcagcatc

SEQ ID NO: 856398 - DNA, 20 bp, mouse
ggagcgaggagaagcagaac

SEQ ID NO: 856399 - DNA, 20 bp, mouse
gtattgccctgcctatccgg

SEQ ID NO: 856400 - DNA, 20 bp, mouse
gagatagactattgttggac

SEQ ID NO: 856401 - DNA, 20 bp, mouse
gcagggcctccggataggca

SEQ ID NO: 856402 - DNA, 20 bp, mouse
gttctattgccctgcctatc

SEQ ID NO: 856403 - DNA, 20 bp, mouse
gggagaagcagaaccggcgg

SEQ ID NO: 856404 - DNA, 20 bp, mouse
gaatagtgctccatagtgat

SEQ ID NO: 856405 - DNA, 20 bp, mouse
gggatggttgccaatcacta

SEQ ID NO: 856406 - DNA, 20 bp, mouse
gggccctgggcaagcagcat

SEQ ID NO: 856407 - DNA, 20 bp, mouse
ggactggcaggacagagtgg

SEQ ID NO: 856408 - DNA, 20 bp, mouse
gctggaaaatggtcggccct

SEQ ID NO: 856409 - DNA, 20 bp, mouse
gaatcagggttgattctccc

SEQ ID NO: 856410 - DNA, 20 bp, mouse
gtatgtcactcgaaacttgc

SEQ ID NO: 856411 - DNA, 20 bp, mouse
gttgatcgctgcatggcaag

SEQ ID NO: 856412 - DNA, 20 bp, mouse
gtttttattctgatatgcat

SEQ ID NO: 856413 - DNA, 20 bp, mouse
gttgacaattgatcgctgca

SEQ ID NO: 856414 - DNA, 20 bp, mouse
gtctgactggcaggacagag

SEQ ID NO: 856415 - DNA, 20 bp, mouse
gtgatgaagggacacagctt

SEQ ID NO: 856416 - DNA, 20 bp, mouse
gtgcagatatgcaaaaagac

SEQ ID NO: 856417 - DNA, 20 bp, mouse
gatcgtccccggacttgggt

SEQ ID NO: 856418 - DNA, 20 bp, mouse
ggtggatcgtccccggactt

SEQ ID NO: 856419 - DNA, 20 bp, mouse
gcctactatgcaattgtact

SEQ ID NO: 856420 - DNA, 20 bp, mouse
ggttttcccacccaagtccg

SEQ ID NO: 856421 - DNA, 20 bp, mouse
ggtgtgcggaagggacagcc

SEQ ID NO: 856422 - DNA, 20 bp, mouse
gtatggaccttgaatgcagg

SEQ ID NO: 856423 - DNA, 20 bp, mouse
gagttatggaccttgaatgc

SEQ ID NO: 856424 - DNA, 20 bp, mouse
gcttcttcctcctgcattca

SEQ ID NO: 856425 - DNA, 20 bp, mouse
gtagggttagagtgtgcgga

SEQ ID NO: 856426 - DNA, 20 bp, mouse
gggaccgagcagttagaatg

SEQ ID NO: 856427 - DNA, 20 bp, mouse
gctctcctgtgcctactcga

SEQ ID NO: 856428 - DNA, 20 bp, mouse
gtgagtgtaggaaaaatgtg

SEQ ID NO: 856429 - DNA, 20 bp, mouse
gtccatctggagtccctgat

SEQ ID NO: 856430 - DNA, 20 bp, mouse
ggccaaactcctcaggtctg

SEQ ID NO: 856431 - DNA, 20 bp, mouse
gcactgcttcacagctatat

SEQ ID NO: 856432 - DNA, 20 bp, mouse
gcagaactgccccagacctg

SEQ ID NO: 856433 - DNA, 20 bp, mouse
gggcagttctgtgcctgagg

SEQ ID NO: 856434 - DNA, 20 bp, mouse
gaagagtgtctactgagtgt

SEQ ID NO: 856435 - DNA, 20 bp, mouse
gggggacaactttgcagttc

SEQ ID NO: 856436 - DNA, 20 bp, mouse
gcgtgggattggagtgctgg

SEQ ID NO: 856437 - DNA, 20 bp, mouse
gcaatcaaaagcactgttat

SEQ ID NO: 856438 - DNA, 20 bp, mouse
ggagggcgggcattgaacga

SEQ ID NO: 856439 - DNA, 20 bp, mouse
gattccctgagaaagtagga

SEQ ID NO: 856440 - DNA, 20 bp, mouse
gtgacctgtctagcatttgt

SEQ ID NO: 856441 - DNA, 20 bp, mouse
gtgttataggaggatccaat

SEQ ID NO: 856442 - DNA, 20 bp, mouse
gtgaccaacaaatgctagac

SEQ ID NO: 856443 - DNA, 20 bp, mouse
gacagtgcttttgattggac

SEQ ID NO: 856444 - DNA, 20 bp, mouse
gatagttactttcactccgt

SEQ ID NO: 856445 - DNA, 20 bp, mouse
gccctgagaaagtaggaggg

SEQ ID NO: 856446 - DNA, 20 bp, mouse
ggcgcaatgcgcagagaccc

SEQ ID NO: 856447 - DNA, 20 bp, mouse
ggcacccgggagagctgacg

SEQ ID NO: 856448 - DNA, 20 bp, mouse
gtccggtagtgaatgcggag

SEQ ID NO: 856449 - DNA, 20 bp, mouse
gcgcgtgcgtctgtgaaggc

SEQ ID NO: 856450 - DNA, 20 bp, mouse
gagctgacgcggagatttct

SEQ ID NO: 856451 - DNA, 20 bp, mouse
gttctgggaagtgtcgtcca

SEQ ID NO: 856452 - DNA, 20 bp, mouse
gggctagggaagtacctgcg

SEQ ID NO: 856453 - DNA, 20 bp, mouse
gtctccgcgtcagctctccc

SEQ ID NO: 856454 - DNA, 20 bp, mouse
gtgggacgtgtcaagttcag

SEQ ID NO: 856455 - DNA, 20 bp, mouse
gcacaaacacgcaggcaccc

SEQ ID NO: 856456 - DNA, 20 bp, mouse
ggggtctcgcggtggaccct

SEQ ID NO: 856457 - DNA, 20 bp, mouse
gcgactcttacgtcaccaga

SEQ ID NO: 856458 - DNA, 20 bp, mouse
gttggctaccgcgtcccctc

SEQ ID NO: 856459 - DNA, 20 bp, mouse
gccagcgccgggtctcgcgg

SEQ ID NO: 856460 - DNA, 20 bp, mouse
ggcggtagccaacctagact

SEQ ID NO: 856461 - DNA, 20 bp, mouse
gttgccagcaaatccttcat

SEQ ID NO: 856462 - DNA, 20 bp, mouse
gcacacaacccagtctaggt

SEQ ID NO: 856463 - DNA, 20 bp, mouse
gtggtgacgtaagagtcgca

SEQ ID NO: 856464 - DNA, 20 bp, mouse
gtggccagcgccgggtctcg

SEQ ID NO: 856465 - DNA, 20 bp, mouse
gggaagatctactgtgaatc

SEQ ID NO: 856466 - DNA, 20 bp, mouse
gggcccaattcctctacctt

SEQ ID NO: 856467 - DNA, 20 bp, mouse
gatcctaaggtagaggaatt

SEQ ID NO: 856468 - DNA, 20 bp, mouse
gagctgctgacagaagtcct

SEQ ID NO: 856469 - DNA, 20 bp, mouse
gctgtcagcagctatgttaa

SEQ ID NO: 856470 - DNA, 20 bp, mouse
gttagaaagctcagaagagg

SEQ ID NO: 856471 - DNA, 20 bp, mouse
gggaacgtggccagagcggt

SEQ ID NO: 856472 - DNA, 20 bp, mouse
gcaacacctctgattggaca

SEQ ID NO: 856473 - DNA, 20 bp, mouse
gctctggccacgttcctaat

SEQ ID NO: 856474 - DNA, 20 bp, mouse
gtcagaagaggcggcttctg

SEQ ID NO: 856475 - DNA, 20 bp, mouse
gtaaaggcaaattttccacc

SEQ ID NO: 856476 - DNA, 20 bp, mouse
gacaactcagttatggacaa

SEQ ID NO: 856477 - DNA, 20 bp, mouse
gtgtcaacattcatatagac

SEQ ID NO: 856478 - DNA, 20 bp, mouse
gcctctacatcaagacaaca

SEQ ID NO: 856479 - DNA, 20 bp, mouse
gggaaaatgactataatctc

SEQ ID NO: 856480 - DNA, 20 bp, mouse
gaattaatacaactcagtta

SEQ ID NO: 856481 - DNA, 20 bp, mouse
ggtagtagttttcttgcatc

SEQ ID NO: 856482 - DNA, 20 bp, mouse
gctatctcaggaatttaaac

SEQ ID NO: 856483 - DNA, 20 bp, mouse
ggaatataacatctgaccat

SEQ ID NO: 856484 - DNA, 20 bp, mouse
gactttatgtgccagataga

SEQ ID NO: 856485 - DNA, 20 bp, mouse
gtgtttcatttccttctatc

SEQ ID NO: 856486 - DNA, 20 bp, mouse
gagccaggaaactgcgtctg

SEQ ID NO: 856487 - DNA, 20 bp, mouse
gctcctcagacgcagtttcc

SEQ ID NO: 856488 - DNA, 20 bp, mouse
ggggaccttccggggccacc

SEQ ID NO: 856489 - DNA, 20 bp, mouse
gtgaggagctttccggtttc

SEQ ID NO: 856490 - DNA, 20 bp, mouse
ggatctcaatttcccgacaa

SEQ ID NO: 856491 - DNA, 20 bp, mouse
gtgatagacccccagttcac

SEQ ID NO: 856492 - DNA, 20 bp, mouse
gtctgttatcttaccgttgt

SEQ ID NO: 856493 - DNA, 20 bp, mouse
gacacaggtagcaaggggaa

SEQ ID NO: 856494 - DNA, 20 bp, mouse
gcaggtagcaaggggaatgg

SEQ ID NO: 856495 - DNA, 20 bp, mouse
gcaccgcagcccggtggccc

SEQ ID NO: 856496 - DNA, 20 bp, mouse
gcgcatctgaggagagttta

SEQ ID NO: 856497 - DNA, 20 bp, mouse
gacacaggtagcaaggggaa

SEQ ID NO: 856498 - DNA, 20 bp, mouse
gcaggtagcaaggggaatgg

SEQ ID NO: 856499 - DNA, 20 bp, mouse
gggcggccctggaaccttgc

SEQ ID NO: 856500 - DNA, 20 bp, mouse
gccatcagccgcgcagccgc

SEQ ID NO: 856501 - DNA, 20 bp, mouse
gtggcctggacatttggagc

SEQ ID NO: 856502 - DNA, 20 bp, mouse
gagaagagaacgcagctgga

SEQ ID NO: 856503 - DNA, 20 bp, mouse
ggactctaccaacgtaatta

SEQ ID NO: 856504 - DNA, 20 bp, mouse
gggagccgctccaaagatcg

SEQ ID NO: 856505 - DNA, 20 bp, mouse
gggacgcggttcccagtctc

SEQ ID NO: 856506 - DNA, 20 bp, mouse
ggcgtccataaaaacagctg

SEQ ID NO: 856507 - DNA, 20 bp, mouse
gcgctctcacagttctgatg

SEQ ID NO: 856508 - DNA, 20 bp, mouse
gtggatctcttacagttgtc

SEQ ID NO: 856509 - DNA, 20 bp, mouse
ggactgaatattctgttaac

SEQ ID NO: 856510 - DNA, 20 bp, mouse
gttgagatcttatgaacagt

SEQ ID NO: 856511 - DNA, 20 bp, mouse
gatgaacagttggtctatca

SEQ ID NO: 856512 - DNA, 20 bp, mouse
gaactcagacgaataattca

SEQ ID NO: 856513 - DNA, 20 bp, mouse
gcacaaagttctacatagca

SEQ ID NO: 856514 - DNA, 20 bp, mouse
gcgttcaaaaaagtgtgcac

SEQ ID NO: 856515 - DNA, 20 bp, mouse
ggcttccgcagctgttttta

SEQ ID NO: 856516 - DNA, 20 bp, mouse
ggggaggagctgttcctgat

SEQ ID NO: 856517 - DNA, 20 bp, mouse
gaggctgcccaaaactgagt

SEQ ID NO: 856518 - DNA, 20 bp, mouse
gtctgagcagatgatttagg

SEQ ID NO: 856519 - DNA, 20 bp, mouse
gaagcctggcaacaagtata

SEQ ID NO: 856520 - DNA, 20 bp, mouse
gaggagctgttcctgatggg

SEQ ID NO: 856521 - DNA, 20 bp, mouse
ggggcaaaacaaaaccagct

SEQ ID NO: 856522 - DNA, 20 bp, mouse
gaagaactcagggagccgca

SEQ ID NO: 856523 - DNA, 20 bp, mouse
gaaccggaagtgggctatgt

SEQ ID NO: 856524 - DNA, 20 bp, mouse
gaaatcatctgctcagacag

SEQ ID NO: 856525 - DNA, 20 bp, mouse
ggaccagaattggatcaaat

SEQ ID NO: 856526 - DNA, 20 bp, mouse
ggctgtgcagagcaggtcta

SEQ ID NO: 856527 - DNA, 20 bp, mouse
gaggggccggaacctccctg

SEQ ID NO: 856528 - DNA, 20 bp, mouse
gtggggcgtgggtacttgtc

SEQ ID NO: 856529 - DNA, 20 bp, mouse
ggctgctggagctttgtagc

SEQ ID NO: 856530 - DNA, 20 bp, mouse
gtacttgtcgggcggggagg

SEQ ID NO: 856531 - DNA, 20 bp, mouse
ggggtctaggaaagtaatta

SEQ ID NO: 856532 - DNA, 20 bp, mouse
gggcgtgggtacttgtcggg

SEQ ID NO: 856533 - DNA, 20 bp, mouse
gtggtgtgaaagcatatcgg

SEQ ID NO: 856534 - DNA, 20 bp, mouse
gcggaacctccctggggcgt

SEQ ID NO: 856535 - DNA, 20 bp, mouse
ggaaccggggccgtagtggg

SEQ ID NO: 856536 - DNA, 20 bp, mouse
gggagggaatggaaccccca

SEQ ID NO: 856537 - DNA, 20 bp, mouse
ggcctttatccctgccctgg

SEQ ID NO: 856538 - DNA, 20 bp, mouse
gtcttgctctcaaactattt

SEQ ID NO: 856539 - DNA, 20 bp, mouse
gagctgatgactgagcggga

SEQ ID NO: 856540 - DNA, 20 bp, mouse
gaggaagctgatgactgagc

SEQ ID NO: 856541 - DNA, 20 bp, mouse
gggaatggaacccccagggc

SEQ ID NO: 856542 - DNA, 20 bp, mouse
gaaaaaagcagtagtaatta

SEQ ID NO: 856543 - DNA, 20 bp, mouse
ggcaggaccttgaccagaac

SEQ ID NO: 856544 - DNA, 20 bp, mouse
gggagagagtaggtaagtgg

SEQ ID NO: 856545 - DNA, 20 bp, mouse
gagcagtagtaattaaggag

SEQ ID NO: 856546 - DNA, 20 bp, mouse
gtgggagggacgtgttcgcg

SEQ ID NO: 856547 - DNA, 20 bp, mouse
gtgggaggagtattcccagt

SEQ ID NO: 856548 - DNA, 20 bp, mouse
gaaccttccaccatgtttct

SEQ ID NO: 856549 - DNA, 20 bp, mouse
gactgggaggctgtgcatag

SEQ ID NO: 856550 - DNA, 20 bp, mouse
gaggttgttagacattaggt

SEQ ID NO: 856551 - DNA, 20 bp, mouse
gagggacgtgttcgcggggc

SEQ ID NO: 856552 - DNA, 20 bp, mouse
gcctgacagctggagctgta

SEQ ID NO: 856553 - DNA, 20 bp, mouse
gcggggtgcagcgtcctatt

SEQ ID NO: 856554 - DNA, 20 bp, mouse
gaggatggggatcagatacc

SEQ ID NO: 856555 - DNA, 20 bp, mouse
gggtgaaagcagtacagtgc

SEQ ID NO: 856556 - DNA, 20 bp, mouse
gtggggttcacatgagagaa

SEQ ID NO: 856557 - DNA, 20 bp, mouse
gacgtggagccttagaaaat

SEQ ID NO: 856558 - DNA, 20 bp, mouse
gtcagaccaaatatctctgt

SEQ ID NO: 856559 - DNA, 20 bp, mouse
gacactgaagcttccttctc

SEQ ID NO: 856560 - DNA, 20 bp, mouse
gggtaattcgatagtggacc

SEQ ID NO: 856561 - DNA, 20 bp, mouse
ggggagggccttgtatgtta

SEQ ID NO: 856562 - DNA, 20 bp, mouse
gcggtgtgatatcttttgta

SEQ ID NO: 856563 - DNA, 20 bp, mouse
gtactactttgggatacttg

SEQ ID NO: 856564 - DNA, 20 bp, mouse
gggccctcccacacaggagc

SEQ ID NO: 856565 - DNA, 20 bp, mouse
gaattcgatagtggacccgg

SEQ ID NO: 856566 - DNA, 20 bp, mouse
ggactggatggagcatatgg

SEQ ID NO: 856567 - DNA, 20 bp, mouse
gccgctgggctcaacctctt

SEQ ID NO: 856568 - DNA, 20 bp, mouse
ggaaccttgcacaggatttc

SEQ ID NO: 856569 - DNA, 20 bp, mouse
gcaccagccacgctgcagaa

SEQ ID NO: 856570 - DNA, 20 bp, mouse
gcctggttcggagcccaaag

SEQ ID NO: 856571 - DNA, 20 bp, mouse
gtctgactggatggagcata

SEQ ID NO: 856572 - DNA, 20 bp, mouse
ggaaatgcagtccatgacga

SEQ ID NO: 856573 - DNA, 20 bp, mouse
gagtcagatattccctggtt

SEQ ID NO: 856574 - DNA, 20 bp, mouse
gaccgtaattctattctgac

SEQ ID NO: 856575 - DNA, 20 bp, mouse
ggcagtccatgacgaggggc

SEQ ID NO: 856576 - DNA, 20 bp, mouse
gaagaagcgcagataatcga

SEQ ID NO: 856577 - DNA, 20 bp, mouse
ggctgcagcggtactcagaa

SEQ ID NO: 856578 - DNA, 20 bp, mouse
gaggggatagggtgtgtagt

SEQ ID NO: 856579 - DNA, 20 bp, mouse
gggagttattcaccaatcaa

SEQ ID NO: 856580 - DNA, 20 bp, mouse
gtgtagcattagttctttag

SEQ ID NO: 856581 - DNA, 20 bp, mouse
gttcaagatggtagcaagtg

SEQ ID NO: 856582 - DNA, 20 bp, mouse
gtgcgcttcttattggacag

SEQ ID NO: 856583 - DNA, 20 bp, mouse
ggacatagggactcttccta

SEQ ID NO: 856584 - DNA, 20 bp, mouse
ggaataacagcgccgttgat

SEQ ID NO: 856585 - DNA, 20 bp, mouse
gtaatgctacagctttacag

SEQ ID NO: 856586 - DNA, 20 bp, mouse
ggtgaacaacccagttctgt

SEQ ID NO: 856587 - DNA, 20 bp, mouse
gaactgggttgttcacctgc

SEQ ID NO: 856588 - DNA, 20 bp, mouse
ggataaacatcactgtgaaa

SEQ ID NO: 856589 - DNA, 20 bp, mouse
gaaagtgcgagttttccatg

SEQ ID NO: 856590 - DNA, 20 bp, mouse
gcaggctaacattgcgtgct

SEQ ID NO: 856591 - DNA, 20 bp, mouse
gtcacagtcaggataccagc

SEQ ID NO: 856592 - DNA, 20 bp, mouse
ggactgtgattccttgaagt

SEQ ID NO: 856593 - DNA, 20 bp, mouse
gagagctcctgggatcgcag

SEQ ID NO: 856594 - DNA, 20 bp, mouse
ggtagcaggcagggtcacca

SEQ ID NO: 856595 - DNA, 20 bp, mouse
gatatgctgcgtagcaggca

SEQ ID NO: 856596 - DNA, 20 bp, mouse
gcaagcagggcagttgtgtc

SEQ ID NO: 856597 - DNA, 20 bp, mouse
gctgaaatgcccattttcat

SEQ ID NO: 856598 - DNA, 20 bp, mouse
gaaaatgggcatttcagcga

SEQ ID NO: 856599 - DNA, 20 bp, mouse
gacggcgagaaccgttgggc

SEQ ID NO: 856600 - DNA, 20 bp, mouse
gtgacaagaccaagtttcag

SEQ ID NO: 856601 - DNA, 20 bp, mouse
gaccttaggtgagttagatg

SEQ ID NO: 856602 - DNA, 20 bp, mouse
gaaacttggtcttgtcaagc

SEQ ID NO: 856603 - DNA, 20 bp, mouse
gcagcgacggcgagaaccgt

SEQ ID NO: 856604 - DNA, 20 bp, mouse
gaatacagaaatggtgacca

SEQ ID NO: 856605 - DNA, 20 bp, mouse
gcctaaggtagaaaacggtg

SEQ ID NO: 856606 - DNA, 20 bp, mouse
gtggacccaggatcaggaaa

SEQ ID NO: 856607 - DNA, 20 bp, mouse
gcctgggtccagactgacat

SEQ ID NO: 856608 - DNA, 20 bp, mouse
gaggatcaggaaaagggacc

SEQ ID NO: 856609 - DNA, 20 bp, mouse
gagaggttcctatgtcagtc

SEQ ID NO: 856610 - DNA, 20 bp, mouse
gggtggtgagttagagacta

SEQ ID NO: 856611 - DNA, 20 bp, mouse
gggcgaatgagaagcggaag

SEQ ID NO: 856612 - DNA, 20 bp, mouse
gagaagcatggatattccga

SEQ ID NO: 856613 - DNA, 20 bp, mouse
gcacttggagcaccctctca

SEQ ID NO: 856614 - DNA, 20 bp, mouse
gctgattggcgaatgagaag

SEQ ID NO: 856615 - DNA, 20 bp, mouse
ggcagcaactaccgcccctt

SEQ ID NO: 856616 - DNA, 20 bp, mouse
gtggacccaggatcaggaaa

SEQ ID NO: 856617 - DNA, 20 bp, mouse
gcctgggtccagactgacat

SEQ ID NO: 856618 - DNA, 20 bp, mouse
ggacctggtatgtaagctcc

SEQ ID NO: 856619 - DNA, 20 bp, mouse
ggtaagctccaggatgatac

SEQ ID NO: 856620 - DNA, 20 bp, mouse
gtagaatgaggaattggaga

SEQ ID NO: 856621 - DNA, 20 bp, mouse
gtggtgaaatgattagaatg

SEQ ID NO: 856622 - DNA, 20 bp, mouse
gaggatcaggaaaagggacc

SEQ ID NO: 856623 - DNA, 20 bp, mouse
gatcctggagcttacatacc

SEQ ID NO: 856624 - DNA, 20 bp, mouse
gagaggttcctatgtcagtc

SEQ ID NO: 856625 - DNA, 20 bp, mouse
gtagttcacctgtatcatcc

SEQ ID NO: 856626 - DNA, 20 bp, mouse
gtagagaagccagactctat

SEQ ID NO: 856627 - DNA, 20 bp, mouse
gcctagtgctcacacctgcg

SEQ ID NO: 856628 - DNA, 20 bp, mouse
ggtcaggggcggaacctcca

SEQ ID NO: 856629 - DNA, 20 bp, mouse
gccagctagccaatagagtc

SEQ ID NO: 856630 - DNA, 20 bp, mouse
gtctacagctcaaaggtgaa

SEQ ID NO: 856631 - DNA, 20 bp, mouse
gtctcaacatgtgaccctag

SEQ ID NO: 856632 - DNA, 20 bp, mouse
gagagccacgccaaccacta

SEQ ID NO: 856633 - DNA, 20 bp, mouse
gcaagcaaggaaatcctagt

SEQ ID NO: 856634 - DNA, 20 bp, mouse
gccacaaggcggctccccat

SEQ ID NO: 856635 - DNA, 20 bp, mouse
ggctcccgcggcagaaacgc

SEQ ID NO: 856636 - DNA, 20 bp, mouse
gacacaaacgggagtcatca

SEQ ID NO: 856637 - DNA, 20 bp, mouse
gggccctgtaagcgcatctg

SEQ ID NO: 856638 - DNA, 20 bp, mouse
gccccacagatgcgcttaca

SEQ ID NO: 856639 - DNA, 20 bp, mouse
gttaatcaatatgtttgtgc

SEQ ID NO: 856640 - DNA, 20 bp, mouse
gtagacaggctcttttagac

SEQ ID NO: 856641 - DNA, 20 bp, mouse
gcacacccacaccaactaag

SEQ ID NO: 856642 - DNA, 20 bp, mouse
gcctgcctcttagttggtgt

SEQ ID NO: 856643 - DNA, 20 bp, mouse
gtcttttagacaggctctat

SEQ ID NO: 856644 - DNA, 20 bp, mouse
gtttgtaaactggacacaaa

SEQ ID NO: 856645 - DNA, 20 bp, mouse
gcttcattaacgattgacat

SEQ ID NO: 856646 - DNA, 20 bp, mouse
gtctgggaaaggtcggtcct

SEQ ID NO: 856647 - DNA, 20 bp, mouse
gcgtggcagggcctccctaa

SEQ ID NO: 856648 - DNA, 20 bp, mouse
ggcagggcctccctaagggc

SEQ ID NO: 856649 - DNA, 20 bp, mouse
gctaccacagccagccctta

SEQ ID NO: 856650 - DNA, 20 bp, mouse
gggctggctgtggtagctat

SEQ ID NO: 856651 - DNA, 20 bp, mouse
gccttcctggagaacctgat

SEQ ID NO: 856652 - DNA, 20 bp, mouse
ggaaaggtcggtcctcggcg

SEQ ID NO: 856653 - DNA, 20 bp, mouse
gaaggcctctcagtcagaag

SEQ ID NO: 856654 - DNA, 20 bp, mouse
gtgacaggaacacatccctt

SEQ ID NO: 856655 - DNA, 20 bp, mouse
ggggccaggcttccacgccg

SEQ ID NO: 856656 - DNA, 20 bp, mouse
gcagttctgtgcctgagcgg

SEQ ID NO: 856657 - DNA, 20 bp, mouse
gggctagcggatccatctgg

SEQ ID NO: 856658 - DNA, 20 bp, mouse
ggccaatcacggcctccaga

SEQ ID NO: 856659 - DNA, 20 bp, mouse
gagagaaagaagtgcacacc

SEQ ID NO: 856660 - DNA, 20 bp, mouse
gatgcatggcgtaatttctc

SEQ ID NO: 856661 - DNA, 20 bp, mouse
ggtgtaaaaaagctttattg

SEQ ID NO: 856662 - DNA, 20 bp, mouse
gaaagctttattggggggtg

SEQ ID NO: 856663 - DNA, 20 bp, mouse
gcttttttacaccagatgca

SEQ ID NO: 856664 - DNA, 20 bp, mouse
gtgtgcctgagcggaggcca

SEQ ID NO: 856665 - DNA, 20 bp, mouse
gcctgagcggaggccagggc

SEQ ID NO: 856666 - DNA, 20 bp, mouse
gagaagggacggcaatagct

SEQ ID NO: 856667 - DNA, 20 bp, mouse
gctagccaatcacggcatga

SEQ ID NO: 856668 - DNA, 20 bp, mouse
gtagctggggtgtacgctat

SEQ ID NO: 856669 - DNA, 20 bp, mouse
ggatctgacagtcttagagg

SEQ ID NO: 856670 - DNA, 20 bp, mouse
ggccaatcacggcatgaagg

SEQ ID NO: 856671 - DNA, 20 bp, mouse
ggaggatctgacagtcttag

SEQ ID NO: 856672 - DNA, 20 bp, mouse
ggtcacagctcacaatgggg

SEQ ID NO: 856673 - DNA, 20 bp, mouse
ggagggtggtttttccggaa

SEQ ID NO: 856674 - DNA, 20 bp, mouse
gcaaagtcacagctcacaat

SEQ ID NO: 856675 - DNA, 20 bp, mouse
gtactaaagttgcagtggag

SEQ ID NO: 856676 - DNA, 20 bp, mouse
ggcggcgcccggcctccgag

SEQ ID NO: 856677 - DNA, 20 bp, mouse
gagcaggctcaggtctgact

SEQ ID NO: 856678 - DNA, 20 bp, mouse
gtcgctggtcctgtctatca

SEQ ID NO: 856679 - DNA, 20 bp, mouse
gagtccggaaactgatgttc

SEQ ID NO: 856680 - DNA, 20 bp, mouse
gggcaccccacagcaggctc

SEQ ID NO: 856681 - DNA, 20 bp, mouse
ggcagcgggaagcctctcgg

SEQ ID NO: 856682 - DNA, 20 bp, mouse
ggttgaaggcgataggtcgc

SEQ ID NO: 856683 - DNA, 20 bp, mouse
gtcaggtctggggttcgcag

SEQ ID NO: 856684 - DNA, 20 bp, mouse
gggcttgtgcgcctggctga

SEQ ID NO: 856685 - DNA, 20 bp, mouse
gcttcccgctgctgattgga

SEQ ID NO: 856686 - DNA, 20 bp, mouse
ggaatcccacacttcggctt

SEQ ID NO: 856687 - DNA, 20 bp, mouse
gcacggttctagaacctgat

SEQ ID NO: 856688 - DNA, 20 bp, mouse
gcacagtgacgacttggtga

SEQ ID NO: 856689 - DNA, 20 bp, mouse
gtgcttagaagcaaggaggg

SEQ ID NO: 856690 - DNA, 20 bp, mouse
ggcttccaaagccgaagtgt

SEQ ID NO: 856691 - DNA, 20 bp, mouse
gttggaagctagtgtcactc

SEQ ID NO: 856692 - DNA, 20 bp, mouse
gggtgtgcacagtgacgact

SEQ ID NO: 856693 - DNA, 20 bp, mouse
ggattgctgcaatgagcact

SEQ ID NO: 856694 - DNA, 20 bp, mouse
ggttctgcttagaagcaagg

SEQ ID NO: 856695 - DNA, 20 bp, mouse
gactggagagcggcaagagg

SEQ ID NO: 856696 - DNA, 20 bp, mouse
gaggagctgaagtgatgacc

SEQ ID NO: 856697 - DNA, 20 bp, mouse
ggaccaggcagtctctgccc

SEQ ID NO: 856698 - DNA, 20 bp, mouse
ggactggcctcctaggtctg

SEQ ID NO: 856699 - DNA, 20 bp, mouse
ggaccatatgctggagtaaa

SEQ ID NO: 856700 - DNA, 20 bp, mouse
gggttccagttgatactgag

SEQ ID NO: 856701 - DNA, 20 bp, mouse
gctgtcaatcagcagtcgct

SEQ ID NO: 856702 - DNA, 20 bp, mouse
ggggcggacctagccaatca

SEQ ID NO: 856703 - DNA, 20 bp, mouse
gagcacttcctagtctaaca

SEQ ID NO: 856704 - DNA, 20 bp, mouse
gtaagcttgaaggccctgat

SEQ ID NO: 856705 - DNA, 20 bp, mouse
gtcaatcagcagtcgctggg

SEQ ID NO: 856706 - DNA, 20 bp, mouse
ggctccctggcgctcctgat

SEQ ID NO: 856707 - DNA, 20 bp, mouse
gccaacgacccaagaccaat

SEQ ID NO: 856708 - DNA, 20 bp, mouse
gcaggagcgccagggagcgg

SEQ ID NO: 856709 - DNA, 20 bp, mouse
gcctggcgctcctgattgga

SEQ ID NO: 856710 - DNA, 20 bp, mouse
gactacactggacgttgagt

SEQ ID NO: 856711 - DNA, 20 bp, mouse
gccagggagcggtgggaggc

SEQ ID NO: 856712 - DNA, 20 bp, mouse
gtgagttggtaaatgcactg

SEQ ID NO: 856713 - DNA, 20 bp, mouse
gaagcaagaaatcactacac

SEQ ID NO: 856714 - DNA, 20 bp, mouse
gagggagtcagatcccgtca

SEQ ID NO: 856715 - DNA, 20 bp, mouse
ggattggatggcttgtctgg

SEQ ID NO: 856716 - DNA, 20 bp, mouse
ggacagggagcaactctctc

SEQ ID NO: 856717 - DNA, 20 bp, mouse
gtggagagatggggcggcaa

SEQ ID NO: 856718 - DNA, 20 bp, mouse
gggtgatctggaatagatgt

SEQ ID NO: 856719 - DNA, 20 bp, mouse
gaggctggggtgtaggctat

SEQ ID NO: 856720 - DNA, 20 bp, mouse
ggatggggcggcaaaggctg

SEQ ID NO: 856721 - DNA, 20 bp, mouse
ggaaacaggaaaatgcattc

SEQ ID NO: 856722 - DNA, 20 bp, mouse
gtgctacttgatgctgtgat

SEQ ID NO: 856723 - DNA, 20 bp, mouse
gaactgtctcacaagtggaa

SEQ ID NO: 856724 - DNA, 20 bp, mouse
gatacaaatctctggtgatc

SEQ ID NO: 856725 - DNA, 20 bp, mouse
ggaaaaaactgtctcacaag

SEQ ID NO: 856726 - DNA, 20 bp, mouse
gcggcgaacacgatcaggag

SEQ ID NO: 856727 - DNA, 20 bp, mouse
gaaagcggatggtccgcctc

SEQ ID NO: 856728 - DNA, 20 bp, mouse
gcgccttgctagcgagaaag

SEQ ID NO: 856729 - DNA, 20 bp, mouse
gcctgagtaggcgaccgcgg

SEQ ID NO: 856730 - DNA, 20 bp, mouse
gaagcctgtgacaacaaaag

SEQ ID NO: 856731 - DNA, 20 bp, mouse
gtggcagcggagggataatc

SEQ ID NO: 856732 - DNA, 20 bp, mouse
ggagcctgagtaggcgaccg

SEQ ID NO: 856733 - DNA, 20 bp, mouse
gcggagcggcgaacacgatc

SEQ ID NO: 856734 - DNA, 20 bp, mouse
gaagcagcaaagttcccggt

SEQ ID NO: 856735 - DNA, 20 bp, mouse
gagcccgaccgtacacatgg

SEQ ID NO: 856736 - DNA, 20 bp, mouse
gaggacagaaggcccggccc

SEQ ID NO: 856737 - DNA, 20 bp, mouse
ggggaaggacggcctgaggg

SEQ ID NO: 856738 - DNA, 20 bp, mouse
gtgggaaggcgctaccgcgg

SEQ ID NO: 856739 - DNA, 20 bp, mouse
gagggcggggtcagcacggg

SEQ ID NO: 856740 - DNA, 20 bp, mouse
gagcgcgaggagcacagatg

SEQ ID NO: 856741 - DNA, 20 bp, mouse
gcctgagggcggggtcagca

SEQ ID NO: 856742 - DNA, 20 bp, mouse
gcccaggctgggtgagtacg

SEQ ID NO: 856743 - DNA, 20 bp, mouse
gctaccgcggaggacggtcc

SEQ ID NO: 856744 - DNA, 20 bp, mouse
gacgagcgctagtttggggc

SEQ ID NO: 856745 - DNA, 20 bp, mouse
gcaggggcagggacaacgtg

SEQ ID NO: 856746 - DNA, 20 bp, mouse
gcaaactcacagcccggcct

SEQ ID NO: 856747 - DNA, 20 bp, mouse
gggcgtgggtgggagttgaa

SEQ ID NO: 856748 - DNA, 20 bp, mouse
ggtggagtgcaaggggatcg

SEQ ID NO: 856749 - DNA, 20 bp, mouse
gtgcaaggggatcgcggcgt

SEQ ID NO: 856750 - DNA, 20 bp, mouse
gtcggtcgcgtggagtgcaa

SEQ ID NO: 856751 - DNA, 20 bp, mouse
gagactatgccatcagcgaa

SEQ ID NO: 856752 - DNA, 20 bp, mouse
ggagacgtgaggtttggagg

SEQ ID NO: 856753 - DNA, 20 bp, mouse
ggggagttgaaggggttgat

SEQ ID NO: 856754 - DNA, 20 bp, mouse
gagagagcgcagggggaccc

SEQ ID NO: 856755 - DNA, 20 bp, mouse
gccatcagcgaaaggaggat

SEQ ID NO: 856756 - DNA, 20 bp, mouse
gccgctgcagggaggctaca

SEQ ID NO: 856757 - DNA, 20 bp, mouse
ggtgactcgcacccgctgca

SEQ ID NO: 856758 - DNA, 20 bp, mouse
gcggatgtggggttctctcg

SEQ ID NO: 856759 - DNA, 20 bp, mouse
gcagggaggctacaaggcgg

SEQ ID NO: 856760 - DNA, 20 bp, mouse
gcccgaggagcggatttctg

SEQ ID NO: 856761 - DNA, 20 bp, mouse
gctgcagggaggctacaagg

SEQ ID NO: 856762 - DNA, 20 bp, mouse
gcgcagggccccccgaggag

SEQ ID NO: 856763 - DNA, 20 bp, mouse
gcgctagtgcgatgcatcct

SEQ ID NO: 856764 - DNA, 20 bp, mouse
gggaggagacaacgatgggg

SEQ ID NO: 856765 - DNA, 20 bp, mouse
gaccccagaaatccgctcct

SEQ ID NO: 856766 - DNA, 20 bp, mouse
ggcggggcttggccggtggg

SEQ ID NO: 856767 - DNA, 20 bp, mouse
gggggcggggcttggccggt

SEQ ID NO: 856768 - DNA, 20 bp, mouse
gtacggaggacgcctaactc

SEQ ID NO: 856769 - DNA, 20 bp, mouse
gactccacgtggcggatggc

SEQ ID NO: 856770 - DNA, 20 bp, mouse
gttggccggtgggcggagac

SEQ ID NO: 856771 - DNA, 20 bp, mouse
gatgatgaaaggacatctta

SEQ ID NO: 856772 - DNA, 20 bp, mouse
gtccctgggactccacgtgg

SEQ ID NO: 856773 - DNA, 20 bp, mouse
gtcagcctgtctccgcccac

SEQ ID NO: 856774 - DNA, 20 bp, mouse
gatccgccacgtggagtccc

SEQ ID NO: 856775 - DNA, 20 bp, mouse
ggggaagtcggttctagacc

SEQ ID NO: 856776 - DNA, 20 bp, mouse
gggacccaccgggcggagga

SEQ ID NO: 856777 - DNA, 20 bp, mouse
ggagcccagtggcctcgctg

SEQ ID NO: 856778 - DNA, 20 bp, mouse
gggcgtcagcgggacccacc

SEQ ID NO: 856779 - DNA, 20 bp, mouse
gagacccaggaaaatgcgga

SEQ ID NO: 856780 - DNA, 20 bp, mouse
gtacccttccgcattttcct

SEQ ID NO: 856781 - DNA, 20 bp, mouse
gcgccaacccggggcgtcag

SEQ ID NO: 856782 - DNA, 20 bp, mouse
gagcgcggaggtggaaagaa

SEQ ID NO: 856783 - DNA, 20 bp, mouse
gcgggcctcccgcctctcga

SEQ ID NO: 856784 - DNA, 20 bp, mouse
gtggccgcggcccacaaaca

SEQ ID NO: 856785 - DNA, 20 bp, mouse
gcctgggtctctctccccgg

SEQ ID NO: 856786 - DNA, 20 bp, mouse
gtcaaatgcagggcaggagc

SEQ ID NO: 856787 - DNA, 20 bp, mouse
ggtggcgtgctgcgtgtcag

SEQ ID NO: 856788 - DNA, 20 bp, mouse
gaagaaaactcagaaccctt

SEQ ID NO: 856789 - DNA, 20 bp, mouse
ggcaacttcaaatgcagggc

SEQ ID NO: 856790 - DNA, 20 bp, mouse
ggtgcggcaacttcaaatgc

SEQ ID NO: 856791 - DNA, 20 bp, mouse
gagggaggaaagaatctata

SEQ ID NO: 856792 - DNA, 20 bp, mouse
gcaggagggggcgtggcgtg

SEQ ID NO: 856793 - DNA, 20 bp, mouse
gtgaagttgccgcacaatgc

SEQ ID NO: 856794 - DNA, 20 bp, mouse
gtaaataccagtgtaccaaa

SEQ ID NO: 856795 - DNA, 20 bp, mouse
gtaaggcaagggagggcagg

SEQ ID NO: 856796 - DNA, 20 bp, mouse
gagccttgattggtcaatac

SEQ ID NO: 856797 - DNA, 20 bp, mouse
gctcaaaatactttgagtag

SEQ ID NO: 856798 - DNA, 20 bp, mouse
gaatactttgagtagtggtt

SEQ ID NO: 856799 - DNA, 20 bp, mouse
gacaaagtctccttgaaagt

SEQ ID NO: 856800 - DNA, 20 bp, mouse
ggacctgtattgaccaatca

SEQ ID NO: 856801 - DNA, 20 bp, mouse
ggtaaagcctcctactttca

SEQ ID NO: 856802 - DNA, 20 bp, mouse
gaagtctccttgaaagtagg

SEQ ID NO: 856803 - DNA, 20 bp, mouse
gattgaccaatcaaggctga

SEQ ID NO: 856804 - DNA, 20 bp, mouse
gattctcaggcagtctaatc

SEQ ID NO: 856805 - DNA, 20 bp, mouse
gtacaggtctccctagccaa

SEQ ID NO: 856806 - DNA, 20 bp, mouse
gcgacgacggggagcgggaa

SEQ ID NO: 856807 - DNA, 20 bp, mouse
gcaggggcggagcgcgacga

SEQ ID NO: 856808 - DNA, 20 bp, mouse
gggagcgcgacgacggggag

SEQ ID NO: 856809 - DNA, 20 bp, mouse
gccggggctgaggtttttgc

SEQ ID NO: 856810 - DNA, 20 bp, mouse
gtaagtcccgaaatgctttc

SEQ ID NO: 856811 - DNA, 20 bp, mouse
gagggaggagcggccagggg

SEQ ID NO: 856812 - DNA, 20 bp, mouse
gcaacgacgatgcttccatc

SEQ ID NO: 856813 - DNA, 20 bp, mouse
gaagcatcgtcgttgcgaat

SEQ ID NO: 856814 - DNA, 20 bp, mouse
gtggccgctcctccctagct

SEQ ID NO: 856815 - DNA, 20 bp, mouse
gggacttagagtctcggccg

SEQ ID NO: 856816 - DNA, 20 bp, mouse
gtccgagcgcaggatcccaa

SEQ ID NO: 856817 - DNA, 20 bp, mouse
gtggaacagcgtccgagcgc

SEQ ID NO: 856818 - DNA, 20 bp, mouse
gccggcgcgcccgcgtggac

SEQ ID NO: 856819 - DNA, 20 bp, mouse
gtggcactagtcacctcctg

SEQ ID NO: 856820 - DNA, 20 bp, mouse
ggccagcagaagagcgtcct

SEQ ID NO: 856821 - DNA, 20 bp, mouse
gcggaggtgagatacagtgt

SEQ ID NO: 856822 - DNA, 20 bp, mouse
gcagaagtgcagggcggcgt

SEQ ID NO: 856823 - DNA, 20 bp, mouse
ggggtccgagccagtccacg

SEQ ID NO: 856824 - DNA, 20 bp, mouse
ggtggccaggcgactccgtt

SEQ ID NO: 856825 - DNA, 20 bp, mouse
gttgcaccagccaaatccag

SEQ ID NO: 856826 - DNA, 20 bp, mouse
gcctccgggcacttcctgaa

SEQ ID NO: 856827 - DNA, 20 bp, mouse
gaatcggaaggcatcatccc

SEQ ID NO: 856828 - DNA, 20 bp, mouse
gggagtctgagcgtgtgcgt

SEQ ID NO: 856829 - DNA, 20 bp, mouse
gaggccccctttttagtcat

SEQ ID NO: 856830 - DNA, 20 bp, mouse
gcagtcagacgagaatcgga

SEQ ID NO: 856831 - DNA, 20 bp, mouse
gcagccagtcagacgagaat

SEQ ID NO: 856832 - DNA, 20 bp, mouse
gtgcgcaggcgcaaaaaagc

SEQ ID NO: 856833 - DNA, 20 bp, mouse
gctccgggtccaggataggg

SEQ ID NO: 856834 - DNA, 20 bp, mouse
gcaccaaggcggggcggcag

SEQ ID NO: 856835 - DNA, 20 bp, mouse
ggctgtggaggagcgcgctg

SEQ ID NO: 856836 - DNA, 20 bp, mouse
gtcctcgagcgcactgaacc

SEQ ID NO: 856837 - DNA, 20 bp, mouse
gcacctatagggtgagtgaa

SEQ ID NO: 856838 - DNA, 20 bp, mouse
gagcgcactgaacctggaag

SEQ ID NO: 856839 - DNA, 20 bp, mouse
gtgagtgaagggcgagtgta

SEQ ID NO: 856840 - DNA, 20 bp, mouse
gaggcgctgccgcaacgggg

SEQ ID NO: 856841 - DNA, 20 bp, mouse
gcgcaggcgctgccgcaacg

SEQ ID NO: 856842 - DNA, 20 bp, mouse
gaggcgcgccgggcagaaac

SEQ ID NO: 856843 - DNA, 20 bp, mouse
gcgcccttcactcaccctat

SEQ ID NO: 856844 - DNA, 20 bp, mouse
gtactgggcccgccccgttg

SEQ ID NO: 856845 - DNA, 20 bp, mouse
gctggaagaggatgctgcgc

SEQ ID NO: 856846 - DNA, 20 bp, mouse
gcctacggctggccaccaat

SEQ ID NO: 856847 - DNA, 20 bp, mouse
ggagaagggcgactctgggg

SEQ ID NO: 856848 - DNA, 20 bp, mouse
gttggagaagggcgactctg

SEQ ID NO: 856849 - DNA, 20 bp, mouse
gtggtggccagccgtagggg

SEQ ID NO: 856850 - DNA, 20 bp, mouse
gacggctggccaccaatcgg

SEQ ID NO: 856851 - DNA, 20 bp, mouse
gtaggggcgggatccttgca

SEQ ID NO: 856852 - DNA, 20 bp, mouse
ggggcaccctcgcccctcta

SEQ ID NO: 856853 - DNA, 20 bp, mouse
gaatcggcggtgaagaccgg

SEQ ID NO: 856854 - DNA, 20 bp, mouse
gccacccagaagaaacgaag

SEQ ID NO: 856855 - DNA, 20 bp, mouse
gccttgcacggattggagaa

SEQ ID NO: 856856 - DNA, 20 bp, mouse
ggattgctacggggactcta

SEQ ID NO: 856857 - DNA, 20 bp, mouse
gagaaggagcaatcataatt

SEQ ID NO: 856858 - DNA, 20 bp, mouse
gagtccccgtagcaatcagg

SEQ ID NO: 856859 - DNA, 20 bp, mouse
gccaaccagtgatagatgat

SEQ ID NO: 856860 - DNA, 20 bp, mouse
gcccccgaaatgaataactg

SEQ ID NO: 856861 - DNA, 20 bp, mouse
gaactgtggatgttgcgaga

SEQ ID NO: 856862 - DNA, 20 bp, mouse
gcgaagagtggtggaacggg

SEQ ID NO: 856863 - DNA, 20 bp, mouse
gatgccacctgattgctacg

SEQ ID NO: 856864 - DNA, 20 bp, mouse
gtccgctagctacaggactg

SEQ ID NO: 856865 - DNA, 20 bp, mouse
gtcctcagtcctgtagctag

SEQ ID NO: 856866 - DNA, 20 bp, mouse
gaaacgagtcatctcttggg

SEQ ID NO: 856867 - DNA, 20 bp, mouse
gcaaggagggaagagtgcgc

SEQ ID NO: 856868 - DNA, 20 bp, mouse
ggcccgggagtcctaggacc

SEQ ID NO: 856869 - DNA, 20 bp, mouse
gccggaggccggacccaagg

SEQ ID NO: 856870 - DNA, 20 bp, mouse
ggccggacccaaggcgggac

SEQ ID NO: 856871 - DNA, 20 bp, mouse
gtgctcacctgcgcttgggt

SEQ ID NO: 856872 - DNA, 20 bp, mouse
gttaacggtgagagagcccc

SEQ ID NO: 856873 - DNA, 20 bp, mouse
gcccaggtcctaggactccc

SEQ ID NO: 856874 - DNA, 20 bp, mouse
gagcccggaggccggaccca

SEQ ID NO: 856875 - DNA, 20 bp, mouse
gcattaaacgagtcatctct

SEQ ID NO: 856876 - DNA, 20 bp, mouse
ggacgcgcaccaagggaggg

SEQ ID NO: 856877 - DNA, 20 bp, mouse
gccgggacgcgcaccaaggg

SEQ ID NO: 856878 - DNA, 20 bp, mouse
gcccgctgcaagtggtggat

SEQ ID NO: 856879 - DNA, 20 bp, mouse
ggagggaggctcaggactac

SEQ ID NO: 856880 - DNA, 20 bp, mouse
gcacccgggacgcgcaccaa

SEQ ID NO: 856881 - DNA, 20 bp, mouse
ggtggggtacggcgtggcgt

SEQ ID NO: 856882 - DNA, 20 bp, mouse
gggcgcctggacagactacg

SEQ ID NO: 856883 - DNA, 20 bp, mouse
gtcccgggtggggtacggcg

SEQ ID NO: 856884 - DNA, 20 bp, mouse
ggcccccggcccgctgcaag

SEQ ID NO: 856885 - DNA, 20 bp, mouse
gcgggcgcgcggaaaggcgc

SEQ ID NO: 856886 - DNA, 20 bp, mouse
gcggccgcaccgggcacgag

SEQ ID NO: 856887 - DNA, 20 bp, mouse
gtcccgggaagccgcgtcag

SEQ ID NO: 856888 - DNA, 20 bp, mouse
gaggtgctggggtctgacgg

SEQ ID NO: 856889 - DNA, 20 bp, mouse
gcccgggagccggaagctgt

SEQ ID NO: 856890 - DNA, 20 bp, mouse
gtggaccccacgtcccgcta

SEQ ID NO: 856891 - DNA, 20 bp, mouse
gtccgagagcgggaatgtga

SEQ ID NO: 856892 - DNA, 20 bp, mouse
ggcaccgggcacgagcggca

SEQ ID NO: 856893 - DNA, 20 bp, mouse
ggggaagccgcgtcaggggc

SEQ ID NO: 856894 - DNA, 20 bp, mouse
gccgtggcccgcccctgacg

SEQ ID NO: 856895 - DNA, 20 bp, mouse
gacgagcggcagggaacgcg

SEQ ID NO: 856896 - DNA, 20 bp, mouse
ggaggaaggcttgactcagc

SEQ ID NO: 856897 - DNA, 20 bp, mouse
gagtcctgaggcagttgagt

SEQ ID NO: 856898 - DNA, 20 bp, mouse
gattgtgcggggatggagga

SEQ ID NO: 856899 - DNA, 20 bp, mouse
ggacactgtgccaacgacaa

SEQ ID NO: 856900 - DNA, 20 bp, mouse
gtgcctcaggactctggaga

SEQ ID NO: 856901 - DNA, 20 bp, mouse
ggacagactgaaaggaagtt

SEQ ID NO: 856902 - DNA, 20 bp, mouse
gctgagagaggctaatagga

SEQ ID NO: 856903 - DNA, 20 bp, mouse
gctagtctatgaagtatctg

SEQ ID NO: 856904 - DNA, 20 bp, mouse
gtgctcccaaggtcacatgg

SEQ ID NO: 856905 - DNA, 20 bp, mouse
gcttctcagacccttgtcgt

SEQ ID NO: 856906 - DNA, 20 bp, mouse
ggggcggcgcaggtcacgtg

SEQ ID NO: 856907 - DNA, 20 bp, mouse
ggccaggagcctcagctgtg

SEQ ID NO: 856908 - DNA, 20 bp, mouse
gacgatgggcgccacctggg

SEQ ID NO: 856909 - DNA, 20 bp, mouse
gcccgccccggctgcaaaga

SEQ ID NO: 856910 - DNA, 20 bp, mouse
gaagatagctagcaaagagg

SEQ ID NO: 856911 - DNA, 20 bp, mouse
gcggagcatgagagaggcga

SEQ ID NO: 856912 - DNA, 20 bp, mouse
ggccgcgcatgggcatcccc

SEQ ID NO: 856913 - DNA, 20 bp, mouse
gcagctgtgtggctcatgat

SEQ ID NO: 856914 - DNA, 20 bp, mouse
gcatcccaggctctgtcaca

SEQ ID NO: 856915 - DNA, 20 bp, mouse
gccaccccccagggataaaa

SEQ ID NO: 856916 - DNA, 20 bp, mouse
gggtcagcgtgaggtcggtg

SEQ ID NO: 856917 - DNA, 20 bp, mouse
gactgtgaggggtcagcgtg

SEQ ID NO: 856918 - DNA, 20 bp, mouse
gtgggcctcagctggactga

SEQ ID NO: 856919 - DNA, 20 bp, mouse
gggtggggttaggaacgcgg

SEQ ID NO: 856920 - DNA, 20 bp, mouse
ggatctgagcaggtacgggt

SEQ ID NO: 856921 - DNA, 20 bp, mouse
gcctcctccaagatctgagc

SEQ ID NO: 856922 - DNA, 20 bp, mouse
ggtacctgctcagatcttgg

SEQ ID NO: 856923 - DNA, 20 bp, mouse
gggggttaggaacgcggcgg

SEQ ID NO: 856924 - DNA, 20 bp, mouse
ggggcggaatcgcatcccag

SEQ ID NO: 856925 - DNA, 20 bp, mouse
ggtcggtggggttaggaacg

SEQ ID NO: 856926 - DNA, 20 bp, mouse
ggagcggcggagtcctcgag

SEQ ID NO: 856927 - DNA, 20 bp, mouse
gtcgcatcccagaggagcgg

SEQ ID NO: 856928 - DNA, 20 bp, mouse
gccgctccctgaacccacaa

SEQ ID NO: 856929 - DNA, 20 bp, mouse
ggcgcccggttctagaggag

SEQ ID NO: 856930 - DNA, 20 bp, mouse
gtcctcctcgcggcccttgt

SEQ ID NO: 856931 - DNA, 20 bp, mouse
ggaggaggagccagccgagg

SEQ ID NO: 856932 - DNA, 20 bp, mouse
gagtcctcgagtggggtgcc

SEQ ID NO: 856933 - DNA, 20 bp, mouse
gaggacctaggcagtttcaa

SEQ ID NO: 856934 - DNA, 20 bp, mouse
gggccctccgagtggttccg

SEQ ID NO: 856935 - DNA, 20 bp, mouse
gaggactccgccgctcctct

SEQ ID NO: 856936 - DNA, 20 bp, mouse
gcccacccggcgcccgactc

SEQ ID NO: 856937 - DNA, 20 bp, mouse
ggggaaaatgcctcgatcag

SEQ ID NO: 856938 - DNA, 20 bp, mouse
ggggctccgtgggaaagagg

SEQ ID NO: 856939 - DNA, 20 bp, mouse
gcgggtggcagctccggtgg

SEQ ID NO: 856940 - DNA, 20 bp, mouse
gcgcccgactcgggctccgt

SEQ ID NO: 856941 - DNA, 20 bp, mouse
gacagaaaaaagccccggta

SEQ ID NO: 856942 - DNA, 20 bp, mouse
gtcgggcgccgggtggggag

SEQ ID NO: 856943 - DNA, 20 bp, mouse
gggggggaggctgcccctaa

SEQ ID NO: 856944 - DNA, 20 bp, mouse
gttcccacggagcccgagtc

SEQ ID NO: 856945 - DNA, 20 bp, mouse
gggagctgccacccgggctc

SEQ ID NO: 856946 - DNA, 20 bp, mouse
gtgcgcatgcgctctgggta

SEQ ID NO: 856947 - DNA, 20 bp, mouse
gcccccagccgagtcgagga

SEQ ID NO: 856948 - DNA, 20 bp, mouse
gccgctccccgcgacgtcaa

SEQ ID NO: 856949 - DNA, 20 bp, mouse
ggcaagccccttgacgtcgc

SEQ ID NO: 856950 - DNA, 20 bp, mouse
ggaggcggggctttgggaac

SEQ ID NO: 856951 - DNA, 20 bp, mouse
gcggatgctgaggccctaag

SEQ ID NO: 856952 - DNA, 20 bp, mouse
gctagcgcctgaggcgaccc

SEQ ID NO: 856953 - DNA, 20 bp, mouse
ggacaactgagcggatgctg

SEQ ID NO: 856954 - DNA, 20 bp, mouse
gggggaggcggacaactgag

SEQ ID NO: 856955 - DNA, 20 bp, mouse
ggggccagcgttctctgtgt

SEQ ID NO: 856956 - DNA, 20 bp, mouse
ggggccgccgcgccaacgaa

SEQ ID NO: 856957 - DNA, 20 bp, mouse
gggccccgggcggggtgtgt

SEQ ID NO: 856958 - DNA, 20 bp, mouse
ggccaccgcgcgcccttcgt

SEQ ID NO: 856959 - DNA, 20 bp, mouse
ggggtcacgtgcgaccgacg

SEQ ID NO: 856960 - DNA, 20 bp, mouse
gcccccacacaccccgcccg

SEQ ID NO: 856961 - DNA, 20 bp, mouse
gcgggcgaggattggtgagg

SEQ ID NO: 856962 - DNA, 20 bp, mouse
gacgcgggcgaggattggtg

SEQ ID NO: 856963 - DNA, 20 bp, mouse
ggaccgacgcgggcgaggat

SEQ ID NO: 856964 - DNA, 20 bp, mouse
gcgcgcgcccttcgttggcg

SEQ ID NO: 856965 - DNA, 20 bp, mouse
gcagccctgttagtcaaaag

SEQ ID NO: 856966 - DNA, 20 bp, mouse
gccacagtgccctagggcag

SEQ ID NO: 856967 - DNA, 20 bp, mouse
gcagccgcgttgacttcatt

SEQ ID NO: 856968 - DNA, 20 bp, mouse
gggagcctggctgagatcag

SEQ ID NO: 856969 - DNA, 20 bp, mouse
gtgccggcggaccaggagcc

SEQ ID NO: 856970 - DNA, 20 bp, mouse
gcggagatcaggtggagcgg

SEQ ID NO: 856971 - DNA, 20 bp, mouse
gaggctaggcgtcgagtcca

SEQ ID NO: 856972 - DNA, 20 bp, mouse
gccgccgaatgaagtcaacg

SEQ ID NO: 856973 - DNA, 20 bp, mouse
gggagaggggggccgccgga

SEQ ID NO: 856974 - DNA, 20 bp, mouse
ggatgccgctgatctcagcc

SEQ ID NO: 856975 - DNA, 20 bp, mouse
ggcgcacagccactgcccta

SEQ ID NO: 856976 - DNA, 20 bp, mouse
gagctggggtcgcccggcag

SEQ ID NO: 856977 - DNA, 20 bp, mouse
gtggccaccgacacaatgat

SEQ ID NO: 856978 - DNA, 20 bp, mouse
gtgggcagcgcgcaccaatg

SEQ ID NO: 856979 - DNA, 20 bp, mouse
gccgggcgaccccagctgat

SEQ ID NO: 856980 - DNA, 20 bp, mouse
gccgggggtcaggtgatctc

SEQ ID NO: 856981 - DNA, 20 bp, mouse
gaatgattggcagcgcgaag

SEQ ID NO: 856982 - DNA, 20 bp, mouse
ggcgctgccaatcattgtgt

SEQ ID NO: 856983 - DNA, 20 bp, mouse
gcgcagctacccaatcagct

SEQ ID NO: 856984 - DNA, 20 bp, mouse
gctgccaatcattgtgtcgg

SEQ ID NO: 856985 - DNA, 20 bp, mouse
gaacccggcggatccctttc

SEQ ID NO: 856986 - DNA, 20 bp, mouse
gcaccggggacgttgacaga

SEQ ID NO: 856987 - DNA, 20 bp, mouse
gtaccctctgtcaacgtccc

SEQ ID NO: 856988 - DNA, 20 bp, mouse
gagtctgtggaaaatccacc

SEQ ID NO: 856989 - DNA, 20 bp, mouse
ggagggggaaaaaaagttgt

SEQ ID NO: 856990 - DNA, 20 bp, mouse
gtctctgcaggaaacgcgag

SEQ ID NO: 856991 - DNA, 20 bp, mouse
gtcttctctcctccagtctg

SEQ ID NO: 856992 - DNA, 20 bp, mouse
gtgagggaagggtggctgtt

SEQ ID NO: 856993 - DNA, 20 bp, mouse
gtactcttaccttgtatatt

SEQ ID NO: 856994 - DNA, 20 bp, mouse
gctgcactgctctttcacta

SEQ ID NO: 856995 - DNA, 20 bp, mouse
gaaacccatccaaatataca

SEQ ID NO: 856996 - DNA, 20 bp, mouse
ggggcacgaagtgaaagcac

SEQ ID NO: 856997 - DNA, 20 bp, mouse
gcacaggcggtgtggtacac

SEQ ID NO: 856998 - DNA, 20 bp, mouse
gcggagactggcattcgaag

SEQ ID NO: 856999 - DNA, 20 bp, mouse
gcgaaggggactgagcccgg

SEQ ID NO: 857000 - DNA, 20 bp, mouse
gtaggcatctcaggggaagc

SEQ ID NO: 857001 - DNA, 20 bp, mouse
gcacgaagtgaaagcacagg

SEQ ID NO: 857002 - DNA, 20 bp, mouse
ggcggtgtggtacacggggg

SEQ ID NO: 857003 - DNA, 20 bp, mouse
gagccgggatgcagagctcc

SEQ ID NO: 857004 - DNA, 20 bp, mouse
gtcggctgcgcgattggctc

SEQ ID NO: 857005 - DNA, 20 bp, mouse
ggcgcgattggctctggttc

SEQ ID NO: 857006 - DNA, 20 bp, mouse
gcagatatgcgtctgtgggt

SEQ ID NO: 857007 - DNA, 20 bp, mouse
gtctgtggatagtgcattct

SEQ ID NO: 857008 - DNA, 20 bp, mouse
gccttcagatatgcgtctgt

SEQ ID NO: 857009 - DNA, 20 bp, mouse
gctagactggaggtcaaaag

SEQ ID NO: 857010 - DNA, 20 bp, mouse
gcctggaacaaaggccaaaa

SEQ ID NO: 857011 - DNA, 20 bp, mouse
gggtgggtggccccagacta

SEQ ID NO: 857012 - DNA, 20 bp, mouse
ggccaaaagggatgtgtgct

SEQ ID NO: 857013 - DNA, 20 bp, mouse
gaggaatggggcgggatttc

SEQ ID NO: 857014 - DNA, 20 bp, mouse
gcatgagccaatgagaattt

SEQ ID NO: 857015 - DNA, 20 bp, mouse
gtgggggcaaacagaataca

SEQ ID NO: 857016 - DNA, 20 bp, mouse
gacagcgcgctgggacctgt

SEQ ID NO: 857017 - DNA, 20 bp, mouse
gcagacgctctgcccttctg

SEQ ID NO: 857018 - DNA, 20 bp, mouse
gaggtcccagcgcgctgtgc

SEQ ID NO: 857019 - DNA, 20 bp, mouse
ggggcggtgccctagagctg

SEQ ID NO: 857020 - DNA, 20 bp, mouse
ggcacccggcacagcgcgct

SEQ ID NO: 857021 - DNA, 20 bp, mouse
gtatagcgagcgcatcttgc

SEQ ID NO: 857022 - DNA, 20 bp, mouse
gggacatgtagtcctgtggg

SEQ ID NO: 857023 - DNA, 20 bp, mouse
gtctcacgccgtccagcctg

SEQ ID NO: 857024 - DNA, 20 bp, mouse
gtggacggcgtgagaccttc

SEQ ID NO: 857025 - DNA, 20 bp, mouse
ggctctagggcaccgcccac

SEQ ID NO: 857026 - DNA, 20 bp, mouse
gcggaagctcaactcgatcc

SEQ ID NO: 857027 - DNA, 20 bp, mouse
gagtcacaaagaccggaagt

SEQ ID NO: 857028 - DNA, 20 bp, mouse
gcacctctggaattgaagac

SEQ ID NO: 857029 - DNA, 20 bp, mouse
gtgcccaagatggaaaagat

SEQ ID NO: 857030 - DNA, 20 bp, mouse
gaactcgatcccggaagatg

SEQ ID NO: 857031 - DNA, 20 bp, mouse
ggacaggcaatcagggctgg

SEQ ID NO: 857032 - DNA, 20 bp, mouse
gcaactggcaaacctcacca

SEQ ID NO: 857033 - DNA, 20 bp, mouse
gaaacctgaacaccctaaac

SEQ ID NO: 857034 - DNA, 20 bp, mouse
gagtcctcccgtgttcctag

SEQ ID NO: 857035 - DNA, 20 bp, mouse
gcgggtctcctctaggaaca

SEQ ID NO: 857036 - DNA, 20 bp, mouse
gacagtcatgacagattgga

SEQ ID NO: 857037 - DNA, 20 bp, mouse
gggactaagatgcatctcta

SEQ ID NO: 857038 - DNA, 20 bp, mouse
gtgtcatgactgtcatgacg

SEQ ID NO: 857039 - DNA, 20 bp, mouse
gaagaggcctcgcctgcgta

SEQ ID NO: 857040 - DNA, 20 bp, mouse
gactgtcatgacgtggcctg

SEQ ID NO: 857041 - DNA, 20 bp, mouse
gaggcgaggcctcttcccag

SEQ ID NO: 857042 - DNA, 20 bp, mouse
gtcatgacagattggatgga

SEQ ID NO: 857043 - DNA, 20 bp, mouse
gaggcctcttcccagaggcg

SEQ ID NO: 857044 - DNA, 20 bp, mouse
gtaattacgcacttccgctt

SEQ ID NO: 857045 - DNA, 20 bp, mouse
gaaggtctttctaagcgccc

SEQ ID NO: 857046 - DNA, 20 bp, mouse
gggtcacagaaaagcgtctg

SEQ ID NO: 857047 - DNA, 20 bp, mouse
gagaagctgaggaagattta

SEQ ID NO: 857048 - DNA, 20 bp, mouse
ggctgcgcgcgcaagacttc

SEQ ID NO: 857049 - DNA, 20 bp, mouse
gtacgattcccggggtccgc

SEQ ID NO: 857050 - DNA, 20 bp, mouse
gttaaggttactgtggatgc

SEQ ID NO: 857051 - DNA, 20 bp, mouse
gctttccataggctattatc

SEQ ID NO: 857052 - DNA, 20 bp, mouse
gtgctgcgccagaggcttag

SEQ ID NO: 857053 - DNA, 20 bp, mouse
gttcccggggtccgctggcc

SEQ ID NO: 857054 - DNA, 20 bp, mouse
gctaggaactacgattcccg

SEQ ID NO: 857055 - DNA, 20 bp, mouse
gtgcaggcaaagctttgtgt

SEQ ID NO: 857056 - DNA, 20 bp, mouse
gtggccgaggtgtacgcggg

SEQ ID NO: 857057 - DNA, 20 bp, mouse
gcatcccgagcccgctagga

SEQ ID NO: 857058 - DNA, 20 bp, mouse
gacacctcggccaggaggcg

SEQ ID NO: 857059 - DNA, 20 bp, mouse
gggcccaggccgggagagca

SEQ ID NO: 857060 - DNA, 20 bp, mouse
gtcctggccgaggtgtacgc

SEQ ID NO: 857061 - DNA, 20 bp, mouse
ggccccgctccgtgctctcc

SEQ ID NO: 857062 - DNA, 20 bp, mouse
gctgccagagccacccaaat

SEQ ID NO: 857063 - DNA, 20 bp, mouse
gcggtgcaggaagtgtccca

SEQ ID NO: 857064 - DNA, 20 bp, mouse
gaagccgcgggccgctgctt

SEQ ID NO: 857065 - DNA, 20 bp, mouse
gttcgcgcggccaccagcca

SEQ ID NO: 857066 - DNA, 20 bp, mouse
gggcgggaaggcatgcgtgg

SEQ ID NO: 857067 - DNA, 20 bp, mouse
gtgggcggagggacacgctg

SEQ ID NO: 857068 - DNA, 20 bp, mouse
ggcttcctcgcgggcaagga

SEQ ID NO: 857069 - DNA, 20 bp, mouse
gcgccccccgcgctctgcgc

SEQ ID NO: 857070 - DNA, 20 bp, mouse
gtcaggccaggcagacgttg

SEQ ID NO: 857071 - DNA, 20 bp, mouse
gcgcgaccggggtccgtgcg

SEQ ID NO: 857072 - DNA, 20 bp, mouse
gccgtgcgaggcttcctcgc

SEQ ID NO: 857073 - DNA, 20 bp, mouse
ggcaccgcgacttgccgccg

SEQ ID NO: 857074 - DNA, 20 bp, mouse
gcattcctaaagtccctcgg

SEQ ID NO: 857075 - DNA, 20 bp, mouse
gaagggaaattctgggcgga

SEQ ID NO: 857076 - DNA, 20 bp, mouse
gaaaaactggaggaagtaaa

SEQ ID NO: 857077 - DNA, 20 bp, mouse
gagggtaggagaaaagacta

SEQ ID NO: 857078 - DNA, 20 bp, mouse
gtacgaggcaaccaagagga

SEQ ID NO: 857079 - DNA, 20 bp, mouse
gagaggacggaaaaaactgg

SEQ ID NO: 857080 - DNA, 20 bp, mouse
gggggatcatagagtgtcgc

SEQ ID NO: 857081 - DNA, 20 bp, mouse
gccaagaggacggaaaaaac

SEQ ID NO: 857082 - DNA, 20 bp, mouse
gcattggacagctaataaga

SEQ ID NO: 857083 - DNA, 20 bp, mouse
ggaagcaaccactaagagga

SEQ ID NO: 857084 - DNA, 20 bp, mouse
ggtgccccgccccccggggt

SEQ ID NO: 857085 - DNA, 20 bp, mouse
gttacgaagcaaccactaag

SEQ ID NO: 857086 - DNA, 20 bp, mouse
gcagaatggggaatgcaggt

SEQ ID NO: 857087 - DNA, 20 bp, mouse
gagcactgtaacaattatga

SEQ ID NO: 857088 - DNA, 20 bp, mouse
gcagagaagcgcatcctaga

SEQ ID NO: 857089 - DNA, 20 bp, mouse
ggacactcacttgtctgaag

SEQ ID NO: 857090 - DNA, 20 bp, mouse
gcagaggaagtaagttatcc

SEQ ID NO: 857091 - DNA, 20 bp, mouse
gtcctagagggcgccggaag

SEQ ID NO: 857092 - DNA, 20 bp, mouse
gacccattattgttggggaa

SEQ ID NO: 857093 - DNA, 20 bp, mouse
ggggaaaggattgtagacta

SEQ ID NO: 857094 - DNA, 20 bp, mouse
gttagatcagaaagaaccaa

SEQ ID NO: 857095 - DNA, 20 bp, mouse
ggcaagtagactttgcagaa

SEQ ID NO: 857096 - DNA, 20 bp, mouse
gaggctgcggaagcgctctt

SEQ ID NO: 857097 - DNA, 20 bp, mouse
gtcaagggtaggaatctagg

SEQ ID NO: 857098 - DNA, 20 bp, mouse
gggaggtcctagcagcacag

SEQ ID NO: 857099 - DNA, 20 bp, mouse
gtagcagcacagcgggaagg

SEQ ID NO: 857100 - DNA, 20 bp, mouse
gtgattggtcagctccacaa

SEQ ID NO: 857101 - DNA, 20 bp, mouse
ggcctctctaggaatcccgg

SEQ ID NO: 857102 - DNA, 20 bp, mouse
gccggggaggcagacctgac

SEQ ID NO: 857103 - DNA, 20 bp, mouse
gacctccgggattcctagag

SEQ ID NO: 857104 - DNA, 20 bp, mouse
gtcctgagcccgcccccttg

SEQ ID NO: 857105 - DNA, 20 bp, mouse
gccagagtgctgcggtgggt

SEQ ID NO: 857106 - DNA, 20 bp, mouse
gagctccctgctccctgcga

SEQ ID NO: 857107 - DNA, 20 bp, mouse
ggtgaactgggacacttctt

SEQ ID NO: 857108 - DNA, 20 bp, mouse
gcctcccctcgcagggagca

SEQ ID NO: 857109 - DNA, 20 bp, mouse
gccggcgccgcgcgtcgcca

SEQ ID NO: 857110 - DNA, 20 bp, mouse
gcgcaggacggtctgaaaat

SEQ ID NO: 857111 - DNA, 20 bp, mouse
gcagactcgggtcgtgaact

SEQ ID NO: 857112 - DNA, 20 bp, mouse
gtctgacccctcccctcgca

SEQ ID NO: 857113 - DNA, 20 bp, mouse
gggtctgaaaatgggcgaaa

SEQ ID NO: 857114 - DNA, 20 bp, mouse
gagatcgggttttctaaccc

SEQ ID NO: 857115 - DNA, 20 bp, mouse
ggaaacacggcaggggcgag

SEQ ID NO: 857116 - DNA, 20 bp, mouse
ggctagaagcaaagcctccg

SEQ ID NO: 857117 - DNA, 20 bp, mouse
gagtggctccagtcacctgc

SEQ ID NO: 857118 - DNA, 20 bp, mouse
gctagctcttagctggtaac

SEQ ID NO: 857119 - DNA, 20 bp, mouse
ggtactcttctcttccccgg

SEQ ID NO: 857120 - DNA, 20 bp, mouse
ggcagggtatacaaggaaac

SEQ ID NO: 857121 - DNA, 20 bp, mouse
gaaaagctaactgaatgtct

SEQ ID NO: 857122 - DNA, 20 bp, mouse
gggagcacctagctcttagc

SEQ ID NO: 857123 - DNA, 20 bp, mouse
gcccaagtacccaaattaaa

SEQ ID NO: 857124 - DNA, 20 bp, mouse
gggtgcagacaggtaaagtg

SEQ ID NO: 857125 - DNA, 20 bp, mouse
gcagttagcttttatcctgc

SEQ ID NO: 857126 - DNA, 20 bp, mouse
ggctggccagacaaaagctt

SEQ ID NO: 857127 - DNA, 20 bp, mouse
gcaggtggagggcggctatg

SEQ ID NO: 857128 - DNA, 20 bp, mouse
ggagcgccctcagctacacc

SEQ ID NO: 857129 - DNA, 20 bp, mouse
gtggctgatcacagatccag

SEQ ID NO: 857130 - DNA, 20 bp, mouse
gggtctgacagctctatggt

SEQ ID NO: 857131 - DNA, 20 bp, mouse
gcctccacctggtgtagctg

SEQ ID NO: 857132 - DNA, 20 bp, mouse
gcggaggtctgacagctcta

SEQ ID NO: 857133 - DNA, 20 bp, mouse
gggctcaggagtatacttaa

SEQ ID NO: 857134 - DNA, 20 bp, mouse
gggctatgcgggacatcctg

SEQ ID NO: 857135 - DNA, 20 bp, mouse
ggggcaagatgcgtgctgcc

SEQ ID NO: 857136 - DNA, 20 bp, mouse
gcccccgtggctctgcagta

SEQ ID NO: 857137 - DNA, 20 bp, mouse
gtgcagtacggacctccctc

SEQ ID NO: 857138 - DNA, 20 bp, mouse
gggaagggggaggcatcctg

SEQ ID NO: 857139 - DNA, 20 bp, mouse
gaggagagccatgcacccgc

SEQ ID NO: 857140 - DNA, 20 bp, mouse
gtacggacctccctccggag

SEQ ID NO: 857141 - DNA, 20 bp, mouse
gggcgaagggcaaaaagcgc

SEQ ID NO: 857142 - DNA, 20 bp, mouse
gctgcagagccacgggggaa

SEQ ID NO: 857143 - DNA, 20 bp, mouse
gggtccgtactgcagagcca

SEQ ID NO: 857144 - DNA, 20 bp, mouse
gtgcatggctctcctattgg

SEQ ID NO: 857145 - DNA, 20 bp, mouse
ggctcccctcatcctccaat

SEQ ID NO: 857146 - DNA, 20 bp, mouse
gtgcgcctgcgccatctccc

SEQ ID NO: 857147 - DNA, 20 bp, mouse
gtgaagctacacggaagtaa

SEQ ID NO: 857148 - DNA, 20 bp, mouse
gtacacggaagtaagggcac

SEQ ID NO: 857149 - DNA, 20 bp, mouse
gctaacgcagtcagaatgag

SEQ ID NO: 857150 - DNA, 20 bp, mouse
ggagatggcgcaggcgcaaa

SEQ ID NO: 857151 - DNA, 20 bp, mouse
gtaggactggagcgattcta

SEQ ID NO: 857152 - DNA, 20 bp, mouse
gaagggagtgtgaagctaca

SEQ ID NO: 857153 - DNA, 20 bp, mouse
ggggccaacgtttttctctc

SEQ ID NO: 857154 - DNA, 20 bp, mouse
ggattctaaggcagtcctgt

SEQ ID NO: 857155 - DNA, 20 bp, mouse
gagagatgagctattcttct

SEQ ID NO: 857156 - DNA, 20 bp, mouse
gcagacccgggacgccgagc

SEQ ID NO: 857157 - DNA, 20 bp, mouse
ggagccatcagggccagggt

SEQ ID NO: 857158 - DNA, 20 bp, mouse
gtaccctaccctggccctga

SEQ ID NO: 857159 - DNA, 20 bp, mouse
gcagctccgaggagccatca

SEQ ID NO: 857160 - DNA, 20 bp, mouse
gccgggacgccgagcaggtg

SEQ ID NO: 857161 - DNA, 20 bp, mouse
gcgcctccgcccaaagacat

SEQ ID NO: 857162 - DNA, 20 bp, mouse
ggcggaacagcgactcgaaa

SEQ ID NO: 857163 - DNA, 20 bp, mouse
gttggcagagcctggtagga

SEQ ID NO: 857164 - DNA, 20 bp, mouse
ggcgcatgtgcacggacaag

SEQ ID NO: 857165 - DNA, 20 bp, mouse
gcctaccctgaaagcgatga

SEQ ID NO: 857166 - DNA, 20 bp, mouse
gggcgggaggagaaccttac

SEQ ID NO: 857167 - DNA, 20 bp, mouse
gtcctcccgccaggtgtcga

SEQ ID NO: 857168 - DNA, 20 bp, mouse
gtcccccctcgacacctggc

SEQ ID NO: 857169 - DNA, 20 bp, mouse
gccaaagcaatgagtgaggt

SEQ ID NO: 857170 - DNA, 20 bp, mouse
ggaccaatgcagtcctgccc

SEQ ID NO: 857171 - DNA, 20 bp, mouse
ggaggacagtcgaaaaaggt

SEQ ID NO: 857172 - DNA, 20 bp, mouse
gcccctcgacacctggcggg

SEQ ID NO: 857173 - DNA, 20 bp, mouse
ggtcccgggcaggactgcat

SEQ ID NO: 857174 - DNA, 20 bp, mouse
gggcgagaaagagaccgggg

SEQ ID NO: 857175 - DNA, 20 bp, mouse
ggtgggcgagaaagagaccg

SEQ ID NO: 857176 - DNA, 20 bp, mouse
gcaaacgcaggaaatggttg

SEQ ID NO: 857177 - DNA, 20 bp, mouse
gcgaaggcgagacagcactg

SEQ ID NO: 857178 - DNA, 20 bp, mouse
ggggaagatgggtaagctaa

SEQ ID NO: 857179 - DNA, 20 bp, mouse
gtcaacgcgccctgctttat

SEQ ID NO: 857180 - DNA, 20 bp, mouse
gggcccgcctgaagggtgac

SEQ ID NO: 857181 - DNA, 20 bp, mouse
gaagcgcagtggcgcgagtt

SEQ ID NO: 857182 - DNA, 20 bp, mouse
gtacgagcacatcaacgagg

SEQ ID NO: 857183 - DNA, 20 bp, mouse
gccttcctaaggtaccgaga

SEQ ID NO: 857184 - DNA, 20 bp, mouse
gaatagccaaacgcaggaaa

SEQ ID NO: 857185 - DNA, 20 bp, mouse
gcgcctgaagggtgactggg

SEQ ID NO: 857186 - DNA, 20 bp, mouse
gcctgggaacggagaagaaa

SEQ ID NO: 857187 - DNA, 20 bp, mouse
ggcgaagggaggcgagaaga

SEQ ID NO: 857188 - DNA, 20 bp, mouse
gcacggagtcacggcgggag

SEQ ID NO: 857189 - DNA, 20 bp, mouse
gggcaagcagagctgcgcgc

SEQ ID NO: 857190 - DNA, 20 bp, mouse
gggtggcgcggtgcctaaca

SEQ ID NO: 857191 - DNA, 20 bp, mouse
gaaaagccggcacggagtca

SEQ ID NO: 857192 - DNA, 20 bp, mouse
ggcagatggagagcgaacca

SEQ ID NO: 857193 - DNA, 20 bp, mouse
gagccggcacggagtcacgg

SEQ ID NO: 857194 - DNA, 20 bp, mouse
gcggaaaagagctgagacct

SEQ ID NO: 857195 - DNA, 20 bp, mouse
ggccggcctcccgcaaaagc

SEQ ID NO: 857196 - DNA, 20 bp, mouse
ggggacgcagggtgcaggcc

SEQ ID NO: 857197 - DNA, 20 bp, mouse
ggccccgagcggtgctccag

SEQ ID NO: 857198 - DNA, 20 bp, mouse
gtgctccagaggctcgggca

SEQ ID NO: 857199 - DNA, 20 bp, mouse
gtggctgtgtagagtctacg

SEQ ID NO: 857200 - DNA, 20 bp, mouse
ggcggtcgcaaaggtgcgga

SEQ ID NO: 857201 - DNA, 20 bp, mouse
gctcgggcagggacgagtgc

SEQ ID NO: 857202 - DNA, 20 bp, mouse
gccgactgggggtgggacta

SEQ ID NO: 857203 - DNA, 20 bp, mouse
gcaccggggcggggccgact

SEQ ID NO: 857204 - DNA, 20 bp, mouse
gagcggtgctccagaggctc

SEQ ID NO: 857205 - DNA, 20 bp, mouse
ggggggtgggactatggcgg

SEQ ID NO: 857206 - DNA, 20 bp, mouse
gtagctgggaaggatgagag

SEQ ID NO: 857207 - DNA, 20 bp, mouse
gcgaccacactgacgttccc

SEQ ID NO: 857208 - DNA, 20 bp, mouse
gcggggtccattgccctctc

SEQ ID NO: 857209 - DNA, 20 bp, mouse
ggcaccgctgctcattcttc

SEQ ID NO: 857210 - DNA, 20 bp, mouse
gatccggtccggttaagcac

SEQ ID NO: 857211 - DNA, 20 bp, mouse
gatggaccccggtgcttaac

SEQ ID NO: 857212 - DNA, 20 bp, mouse
gacccgccaaagcaaaggag

SEQ ID NO: 857213 - DNA, 20 bp, mouse
gtgcacctgaaatatccctc

SEQ ID NO: 857214 - DNA, 20 bp, mouse
gccccggtgcttaaccggac

SEQ ID NO: 857215 - DNA, 20 bp, mouse
gtggtaacccgccaaagcaa

SEQ ID NO: 857216 - DNA, 20 bp, mouse
gttgacggggcgggtcaggg

SEQ ID NO: 857217 - DNA, 20 bp, mouse
gggcagctaaggtgacatta

SEQ ID NO: 857218 - DNA, 20 bp, mouse
ggcgcaccgcggtccgcctg

SEQ ID NO: 857219 - DNA, 20 bp, mouse
gtaagcaggagaggttgacg

SEQ ID NO: 857220 - DNA, 20 bp, mouse
gcaggagaggttgacggggc

SEQ ID NO: 857221 - DNA, 20 bp, mouse
gccgcaaaggcctccgggag

SEQ ID NO: 857222 - DNA, 20 bp, mouse
gaacgaaaaacgggcagcta

SEQ ID NO: 857223 - DNA, 20 bp, mouse
gaggttgacggggcgggtca

SEQ ID NO: 857224 - DNA, 20 bp, mouse
gggcgggggatggactaagc

SEQ ID NO: 857225 - DNA, 20 bp, mouse
ggccgtgcaaacaaccccgc

SEQ ID NO: 857226 - DNA, 20 bp, mouse
gccccccccccccgcgggct

SEQ ID NO: 857227 - DNA, 20 bp, mouse
ggggcgggcggtcttcgtcg

SEQ ID NO: 857228 - DNA, 20 bp, mouse
gcggcccagcccgcgggggg

SEQ ID NO: 857229 - DNA, 20 bp, mouse
ggcgagcccggcagtgcctg

SEQ ID NO: 857230 - DNA, 20 bp, mouse
gcccccaagacccgggcgac

SEQ ID NO: 857231 - DNA, 20 bp, mouse
gccgggctcgccagtcgccc

SEQ ID NO: 857232 - DNA, 20 bp, mouse
gcttcgtcgaggcttcccgt

SEQ ID NO: 857233 - DNA, 20 bp, mouse
gggtccgccgcaggcactgc

SEQ ID NO: 857234 - DNA, 20 bp, mouse
ggggccggcccagcccgcgg

SEQ ID NO: 857235 - DNA, 20 bp, mouse
gtgcctgcggcggaccgagg

SEQ ID NO: 857236 - DNA, 20 bp, mouse
gcacttgggtagtaagtagt

SEQ ID NO: 857237 - DNA, 20 bp, mouse
gtgcagggaaagggacctga

SEQ ID NO: 857238 - DNA, 20 bp, mouse
gctaaggggtcaaggaggtt

SEQ ID NO: 857239 - DNA, 20 bp, mouse
gcccctccctaccccatagc

SEQ ID NO: 857240 - DNA, 20 bp, mouse
ggggcccagggcaactgctt

SEQ ID NO: 857241 - DNA, 20 bp, mouse
ggtggtggtaatacttgcga

SEQ ID NO: 857242 - DNA, 20 bp, mouse
gcagattgaggcttacacat

SEQ ID NO: 857243 - DNA, 20 bp, mouse
ggtagtaggctgttttgcgt

SEQ ID NO: 857244 - DNA, 20 bp, mouse
gagggcaccaagcctgctat

SEQ ID NO: 857245 - DNA, 20 bp, mouse
gaccaagcctgctatggggt

SEQ ID NO: 857246 - DNA, 20 bp, mouse
gcccggggccccgttagttg

SEQ ID NO: 857247 - DNA, 20 bp, mouse
gtgccagcgaccaatcccat

SEQ ID NO: 857248 - DNA, 20 bp, mouse
ggagtggagtgccgtcactg

SEQ ID NO: 857249 - DNA, 20 bp, mouse
gctaacggggccccgggcgg

SEQ ID NO: 857250 - DNA, 20 bp, mouse
gagagtgggctctggagata

SEQ ID NO: 857251 - DNA, 20 bp, mouse
gggggcgccgccttccccgg

SEQ ID NO: 857252 - DNA, 20 bp, mouse
ggcgccccctctccaccgaa

SEQ ID NO: 857253 - DNA, 20 bp, mouse
gtgggctgggagtctcgcgc

SEQ ID NO: 857254 - DNA, 20 bp, mouse
gccactccgcaatttccagg

SEQ ID NO: 857255 - DNA, 20 bp, mouse
gagcccgcccccggggaagg

SEQ ID NO: 857256 - DNA, 20 bp, mouse
gcgcgcacgctcaggaccgg

SEQ ID NO: 857257 - DNA, 20 bp, mouse
gcatcaggggcgcgcgcaag

SEQ ID NO: 857258 - DNA, 20 bp, mouse
gcgtgcgcggtgagtggccc

SEQ ID NO: 857259 - DNA, 20 bp, mouse
ggcctccaaggggccccgtg

SEQ ID NO: 857260 - DNA, 20 bp, mouse
gtggcgcgcctgcgcatcag

SEQ ID NO: 857261 - DNA, 20 bp, mouse
gtccaaggggccccgtgagg

SEQ ID NO: 857262 - DNA, 20 bp, mouse
gtgctcccaccactcaacta

SEQ ID NO: 857263 - DNA, 20 bp, mouse
gcctgagcgtgcgcggtgag

SEQ ID NO: 857264 - DNA, 20 bp, mouse
gtcaggaccgggggcttggt

SEQ ID NO: 857265 - DNA, 20 bp, mouse
gcaccgcgcacgctcaggac

SEQ ID NO: 857266 - DNA, 20 bp, mouse
ggggcgggcgatattcgtcg

SEQ ID NO: 857267 - DNA, 20 bp, mouse
gagggagggccggcccagcc

SEQ ID NO: 857268 - DNA, 20 bp, mouse
ggcgagcccggcaatgcctg

SEQ ID NO: 857269 - DNA, 20 bp, mouse
gcccccaagaccccggcgac

SEQ ID NO: 857270 - DNA, 20 bp, mouse
gggtccgccgcaggcattgc

SEQ ID NO: 857271 - DNA, 20 bp, mouse
gtcgccagtcgccggggtct

SEQ ID NO: 857272 - DNA, 20 bp, mouse
gtccccttgcggccgcggcc

SEQ ID NO: 857273 - DNA, 20 bp, mouse
gattcgtcgaggcttccggt

SEQ ID NO: 857274 - DNA, 20 bp, mouse
gcgatattcgtcgaggcttc

SEQ ID NO: 857275 - DNA, 20 bp, mouse
gaatgcctgcggcggaccga

SEQ ID NO: 857276 - DNA, 20 bp, mouse
gtggaggcgggtgtcctacc

SEQ ID NO: 857277 - DNA, 20 bp, mouse
gcaaaagcattcaaggtctc

SEQ ID NO: 857278 - DNA, 20 bp, mouse
ggctaggtctagggcatgat

SEQ ID NO: 857279 - DNA, 20 bp, mouse
ggaaagccgctcaggcctgt

SEQ ID NO: 857280 - DNA, 20 bp, mouse
gggagggccacgccccgttt

SEQ ID NO: 857281 - DNA, 20 bp, mouse
gcgcccccgccagaagggga

SEQ ID NO: 857282 - DNA, 20 bp, mouse
ggggctagagaaagccgctc

SEQ ID NO: 857283 - DNA, 20 bp, mouse
gcggcgcctagtcacgtgga

SEQ ID NO: 857284 - DNA, 20 bp, mouse
gtgccccctcacaagcccac

SEQ ID NO: 857285 - DNA, 20 bp, mouse
ggctgggacggctaggtcta

SEQ ID NO: 857286 - DNA, 20 bp, mouse
gcgagtgggtctggcatctg

SEQ ID NO: 857287 - DNA, 20 bp, mouse
ggaggtgtggcgagtgggtc

SEQ ID NO: 857288 - DNA, 20 bp, mouse
gctggggaggtgtggcgagt

SEQ ID NO: 857289 - DNA, 20 bp, mouse
gcggtagctaccctattgag

SEQ ID NO: 857290 - DNA, 20 bp, mouse
gatctggggctgcttattgg

SEQ ID NO: 857291 - DNA, 20 bp, mouse
gccaagctccctcgtttcca

SEQ ID NO: 857292 - DNA, 20 bp, mouse
gctgtcttagcccctcaata

SEQ ID NO: 857293 - DNA, 20 bp, mouse
gtcacagctgtgcaagccct

SEQ ID NO: 857294 - DNA, 20 bp, mouse
gggcatctggggctgcttat

SEQ ID NO: 857295 - DNA, 20 bp, mouse
ggggctgcttattggcggtg

SEQ ID NO: 857296 - DNA, 20 bp, mouse
gcggagggctcggggctcga

SEQ ID NO: 857297 - DNA, 20 bp, mouse
gcgcgcgccggggcgaaacc

SEQ ID NO: 857298 - DNA, 20 bp, mouse
ggcctcgcccggtttcgccc

SEQ ID NO: 857299 - DNA, 20 bp, mouse
gccgcgccgccgtcgggctg

SEQ ID NO: 857300 - DNA, 20 bp, mouse
gaggcgccggagacaggtcg

SEQ ID NO: 857301 - DNA, 20 bp, mouse
gggccgcgcaagtcccgcgc

SEQ ID NO: 857302 - DNA, 20 bp, mouse
gcgtctcctcagcccgacgg

SEQ ID NO: 857303 - DNA, 20 bp, mouse
gctgacccgagtgggtaaga

SEQ ID NO: 857304 - DNA, 20 bp, mouse
ggacgcctggggggcaaagt

SEQ ID NO: 857305 - DNA, 20 bp, mouse
ggggccgagctgcgcacggg

SEQ ID NO: 857306 - DNA, 20 bp, mouse
ggactgcgacaattggggag

SEQ ID NO: 857307 - DNA, 20 bp, mouse
gcctggggagaactatacgg

SEQ ID NO: 857308 - DNA, 20 bp, mouse
gggactgactgcgacaattg

SEQ ID NO: 857309 - DNA, 20 bp, mouse
ggagcctggggagaactata

SEQ ID NO: 857310 - DNA, 20 bp, mouse
ggggagaactatacggtggc

SEQ ID NO: 857311 - DNA, 20 bp, mouse
gccggacgtcgggatttcaa

SEQ ID NO: 857312 - DNA, 20 bp, mouse
gctacatggcagtcaagttc

SEQ ID NO: 857313 - DNA, 20 bp, mouse
gtactggcggacataggaaa

SEQ ID NO: 857314 - DNA, 20 bp, mouse
gcccgtcgggaagcgtctag

SEQ ID NO: 857315 - DNA, 20 bp, mouse
gtgttctgggaaagcccgtc

SEQ ID NO: 857316 - DNA, 20 bp, mouse
gaccctgccaggttagtcgg

SEQ ID NO: 857317 - DNA, 20 bp, mouse
gcaaagccccgcctcatctc

SEQ ID NO: 857318 - DNA, 20 bp, mouse
gtagagaattggctggatgt

SEQ ID NO: 857319 - DNA, 20 bp, mouse
gggcttctgcggagcttgtt

SEQ ID NO: 857320 - DNA, 20 bp, mouse
gagaagccggagatgaggcg

SEQ ID NO: 857321 - DNA, 20 bp, mouse
gtccgcagaagccggagatg

SEQ ID NO: 857322 - DNA, 20 bp, mouse
ggcgcccagctcccagtcgg

SEQ ID NO: 857323 - DNA, 20 bp, mouse
gctgtccggaaccgaccgtc

SEQ ID NO: 857324 - DNA, 20 bp, mouse
ggcaaccagggcagtgtcgc

SEQ ID NO: 857325 - DNA, 20 bp, mouse
gtgggagctgggcgcaaagc

SEQ ID NO: 857326 - DNA, 20 bp, mouse
ggggactaggaaacagacgc

SEQ ID NO: 857327 - DNA, 20 bp, mouse
gaacgcaagcagctagtctc

SEQ ID NO: 857328 - DNA, 20 bp, mouse
gccgcggccaagtgaccaat

SEQ ID NO: 857329 - DNA, 20 bp, mouse
gaggccgcggcactccgggt

SEQ ID NO: 857330 - DNA, 20 bp, mouse
gaaaaagaaccaagtgcggg

SEQ ID NO: 857331 - DNA, 20 bp, mouse
ggcgcgccacgaccggcgaa

SEQ ID NO: 857332 - DNA, 20 bp, mouse
gacacaccccccaccggcgg

SEQ ID NO: 857333 - DNA, 20 bp, mouse
ggaagggcgcgtctcgcgat

SEQ ID NO: 857334 - DNA, 20 bp, mouse
gccggtccggagcctcccga

SEQ ID NO: 857335 - DNA, 20 bp, mouse
gagaaccaagtgcgggggga

SEQ ID NO: 857336 - DNA, 20 bp, mouse
gcctgtgcatagaaaaagac

SEQ ID NO: 857337 - DNA, 20 bp, mouse
gctcacaaagataatcgctc

SEQ ID NO: 857338 - DNA, 20 bp, mouse
gcatccccgattggctgccc

SEQ ID NO: 857339 - DNA, 20 bp, mouse
gggggatcgagccagggggt

SEQ ID NO: 857340 - DNA, 20 bp, mouse
gaggagggaaaacttgggac

SEQ ID NO: 857341 - DNA, 20 bp, mouse
gaggacaaagtcgagcttag

SEQ ID NO: 857342 - DNA, 20 bp, mouse
ggtgtaaagccgccgccgat

SEQ ID NO: 857343 - DNA, 20 bp, mouse
gaagtgtttcagccaatcgg

SEQ ID NO: 857344 - DNA, 20 bp, mouse
gttggccggggcagccaatc

SEQ ID NO: 857345 - DNA, 20 bp, mouse
ggtgggagaagtgcttgtgg

SEQ ID NO: 857346 - DNA, 20 bp, mouse
ggggccggcctcgtatccac

SEQ ID NO: 857347 - DNA, 20 bp, mouse
gaggcctgtggatacgaggc

SEQ ID NO: 857348 - DNA, 20 bp, mouse
gtagatagatctaaggcctg

SEQ ID NO: 857349 - DNA, 20 bp, mouse
gcacagccacacggcagccg

SEQ ID NO: 857350 - DNA, 20 bp, mouse
ggatgaattagatagatcta

SEQ ID NO: 857351 - DNA, 20 bp, mouse
ggcccaagagccatttatta

SEQ ID NO: 857352 - DNA, 20 bp, mouse
gggctcttgggcgccgtgca

SEQ ID NO: 857353 - DNA, 20 bp, mouse
ggacacctttgcaataggcc

SEQ ID NO: 857354 - DNA, 20 bp, mouse
gacaaggacacctttgcaat

SEQ ID NO: 857355 - DNA, 20 bp, mouse
gatcaccctcggctgccgtg

SEQ ID NO: 857356 - DNA, 20 bp, mouse
gaccgatcgctcggccctgg

SEQ ID NO: 857357 - DNA, 20 bp, mouse
gctgcagcgcccaaggggtg

SEQ ID NO: 857358 - DNA, 20 bp, mouse
gtgcggggaaggggccggtg

SEQ ID NO: 857359 - DNA, 20 bp, mouse
gaactctcgcggtattcacg

SEQ ID NO: 857360 - DNA, 20 bp, mouse
gagcggcggaacggccccac

SEQ ID NO: 857361 - DNA, 20 bp, mouse
gggccgccgctgcggggaag

SEQ ID NO: 857362 - DNA, 20 bp, mouse
ggcagtgcggtccgtggccc

SEQ ID NO: 857363 - DNA, 20 bp, mouse
gtggcccggccgcacccctt

SEQ ID NO: 857364 - DNA, 20 bp, mouse
gtggcctaagggacagatag

SEQ ID NO: 857365 - DNA, 20 bp, mouse
ggcctccagggccgagcgat

SEQ ID NO: 857366 - DNA, 20 bp, mouse
gggcgagcccggcctctcgc

SEQ ID NO: 857367 - DNA, 20 bp, mouse
ggggcgagtagcctagtggg

SEQ ID NO: 857368 - DNA, 20 bp, mouse
ggaggccgcgcaggacgagg

SEQ ID NO: 857369 - DNA, 20 bp, mouse
gcttccgcccgccccgaggg

SEQ ID NO: 857370 - DNA, 20 bp, mouse
gcgcctgcgcccccgccctc

SEQ ID NO: 857371 - DNA, 20 bp, mouse
gggcccagtgagcacgggga

SEQ ID NO: 857372 - DNA, 20 bp, mouse
gagcctagtgggcggcccgg

SEQ ID NO: 857373 - DNA, 20 bp, mouse
ggcggggcgagtagcctagt

SEQ ID NO: 857374 - DNA, 20 bp, mouse
gccgcgacctgccagggccg

SEQ ID NO: 857375 - DNA, 20 bp, mouse
ggcctcagcgcccgcggtag

SEQ ID NO: 857376 - DNA, 20 bp, mouse
ggcgccccggggtcgatcgg

SEQ ID NO: 857377 - DNA, 20 bp, mouse
ggccgcccgggttctcacct

SEQ ID NO: 857378 - DNA, 20 bp, mouse
gcggaggcagaagttacggg

SEQ ID NO: 857379 - DNA, 20 bp, mouse
gtcccggggcgtcggaatcc

SEQ ID NO: 857380 - DNA, 20 bp, mouse
gtccgggcctgccgcagcca

SEQ ID NO: 857381 - DNA, 20 bp, mouse
ggctctgagcacaccccttc

SEQ ID NO: 857382 - DNA, 20 bp, mouse
gggagcaggagcaaaagccg

SEQ ID NO: 857383 - DNA, 20 bp, mouse
ggtgctgctagccatggctg

SEQ ID NO: 857384 - DNA, 20 bp, mouse
ggagcaaaagccggggttcc

SEQ ID NO: 857385 - DNA, 20 bp, mouse
gtgctcagagcaagggtcgg

SEQ ID NO: 857386 - DNA, 20 bp, mouse
ggcgagcaaacctgttcctt

SEQ ID NO: 857387 - DNA, 20 bp, mouse
gcaaccacccccacacataa

SEQ ID NO: 857388 - DNA, 20 bp, mouse
gggaagtggcggagctgata

SEQ ID NO: 857389 - DNA, 20 bp, mouse
gaagaccctggtgtgttgtt

SEQ ID NO: 857390 - DNA, 20 bp, mouse
gaaagaagcgccggaagtgg

SEQ ID NO: 857391 - DNA, 20 bp, mouse
gcgcttgctcaaagaagtac

SEQ ID NO: 857392 - DNA, 20 bp, mouse
gaggtttgctcgccgaattt

SEQ ID NO: 857393 - DNA, 20 bp, mouse
gaccaaagaagcgccggaag

SEQ ID NO: 857394 - DNA, 20 bp, mouse
ggtcgtccaaactcttccaa

SEQ ID NO: 857395 - DNA, 20 bp, mouse
gctgttcctttggaagagtt

SEQ ID NO: 857396 - DNA, 20 bp, mouse
gtatcgacactctacaggtg

SEQ ID NO: 857397 - DNA, 20 bp, mouse
ggaggcctagaatagagaac

SEQ ID NO: 857398 - DNA, 20 bp, mouse
gcacagcgctccgcactcat

SEQ ID NO: 857399 - DNA, 20 bp, mouse
gagtgagcgcgggtgtcttc

SEQ ID NO: 857400 - DNA, 20 bp, mouse
gtactgtatcgacactctac

SEQ ID NO: 857401 - DNA, 20 bp, mouse
gtacgtgtgcgcctgtgccg

SEQ ID NO: 857402 - DNA, 20 bp, mouse
gtcgctgaattgtaggactg

SEQ ID NO: 857403 - DNA, 20 bp, mouse
gcgtggcctgatctaatcag

SEQ ID NO: 857404 - DNA, 20 bp, mouse
gaagtcgggcaacggtattt

SEQ ID NO: 857405 - DNA, 20 bp, mouse
gctacaatgtccagacactg

SEQ ID NO: 857406 - DNA, 20 bp, mouse
gcctgggtgggagtcctggt

SEQ ID NO: 857407 - DNA, 20 bp, mouse
gtggcaagatccccgcccct

SEQ ID NO: 857408 - DNA, 20 bp, mouse
ggcgctgaaactgctgtctt

SEQ ID NO: 857409 - DNA, 20 bp, mouse
gcgcccctgggtgggagtcc

SEQ ID NO: 857410 - DNA, 20 bp, mouse
gaggtgagaccacgcccacc

SEQ ID NO: 857411 - DNA, 20 bp, mouse
gtggttcgtaaccttaccag

SEQ ID NO: 857412 - DNA, 20 bp, mouse
gcagcgcctgagaaaggatg

SEQ ID NO: 857413 - DNA, 20 bp, mouse
gtcttgccacatcctttctc

SEQ ID NO: 857414 - DNA, 20 bp, mouse
gggccccactccttaaagcc

SEQ ID NO: 857415 - DNA, 20 bp, mouse
gaaactgctgtcttgggaac

SEQ ID NO: 857416 - DNA, 20 bp, mouse
gcgcccgatcccaaggcgtc

SEQ ID NO: 857417 - DNA, 20 bp, mouse
gctagcccgcgtctgggatc

SEQ ID NO: 857418 - DNA, 20 bp, mouse
gggcaacgagtgcgcccgga

SEQ ID NO: 857419 - DNA, 20 bp, mouse
gaaggcgagtagccagagtt

SEQ ID NO: 857420 - DNA, 20 bp, mouse
gtgcccgacgccttgggatc

SEQ ID NO: 857421 - DNA, 20 bp, mouse
gtcacgacccaacggccacc

SEQ ID NO: 857422 - DNA, 20 bp, mouse
ggtagcggacggcctaactc

SEQ ID NO: 857423 - DNA, 20 bp, mouse
gctacacatagcagggtaag

SEQ ID NO: 857424 - DNA, 20 bp, mouse
gtcaatggcgcacatattgg

SEQ ID NO: 857425 - DNA, 20 bp, mouse
gcgaagacgctctagccctc

SEQ ID NO: 857426 - DNA, 20 bp, mouse
gctagcccgcgtctgggatc

SEQ ID NO: 857427 - DNA, 20 bp, mouse
gtcctctgacagcaagagtt

SEQ ID NO: 857428 - DNA, 20 bp, mouse
gcgcccgatcccaaggcgtc

SEQ ID NO: 857429 - DNA, 20 bp, mouse
gtgcccgacgccttgggatc

SEQ ID NO: 857430 - DNA, 20 bp, mouse
ggggcgctctagcccgcgtc

SEQ ID NO: 857431 - DNA, 20 bp, mouse
ggctgctggggaacctcatt

SEQ ID NO: 857432 - DNA, 20 bp, mouse
gaagcgatggggaaccttca

SEQ ID NO: 857433 - DNA, 20 bp, mouse
gggcaacgagtgcgcccgga

SEQ ID NO: 857434 - DNA, 20 bp, mouse
gggtggaagggtctacggtg

SEQ ID NO: 857435 - DNA, 20 bp, mouse
ggagtcccgatcccagacgc

SEQ ID NO: 857436 - DNA, 20 bp, mouse
gcggggcgcaggcggtaggt

SEQ ID NO: 857437 - DNA, 20 bp, mouse
gctctgtcgcagacgcccgg

SEQ ID NO: 857438 - DNA, 20 bp, mouse
ggctcgctgctgcgccgcag

SEQ ID NO: 857439 - DNA, 20 bp, mouse
gccaccagagggtgctgtga

SEQ ID NO: 857440 - DNA, 20 bp, mouse
gacagaggtcagacttcctc

SEQ ID NO: 857441 - DNA, 20 bp, mouse
gcagcgagctgcggccttgg

SEQ ID NO: 857442 - DNA, 20 bp, mouse
ggcggcgcagcagcgagctg

SEQ ID NO: 857443 - DNA, 20 bp, mouse
gcgccgcaggggccgcgaag

SEQ ID NO: 857444 - DNA, 20 bp, mouse
gtgacccttcaaacccaggt

SEQ ID NO: 857445 - DNA, 20 bp, mouse
gcgccgggttaaccccttcg

SEQ ID NO: 857446 - DNA, 20 bp, mouse
gggtgggggagtctcctgga

SEQ ID NO: 857447 - DNA, 20 bp, mouse
gcccgcccagcatgtggtga

SEQ ID NO: 857448 - DNA, 20 bp, mouse
gctagctctgccctacaact

SEQ ID NO: 857449 - DNA, 20 bp, mouse
gcgtgtctggagctttgagt

SEQ ID NO: 857450 - DNA, 20 bp, mouse
gccgccttctgattggtggt

SEQ ID NO: 857451 - DNA, 20 bp, mouse
gaccggtggctccgccctcc

SEQ ID NO: 857452 - DNA, 20 bp, mouse
gggaggggccgccttctgat

SEQ ID NO: 857453 - DNA, 20 bp, mouse
ggaacgccctagccaggaaa

SEQ ID NO: 857454 - DNA, 20 bp, mouse
ggcgggtcggcctagttgta

SEQ ID NO: 857455 - DNA, 20 bp, mouse
gggggccgccttctgattgg

SEQ ID NO: 857456 - DNA, 20 bp, mouse
gtcacagtaactgaaagcat

SEQ ID NO: 857457 - DNA, 20 bp, mouse
gacagtggcacaggtcaccc

SEQ ID NO: 857458 - DNA, 20 bp, mouse
gaaagaaccttgtgtgacag

SEQ ID NO: 857459 - DNA, 20 bp, mouse
gagcaagccgctagaagctg

SEQ ID NO: 857460 - DNA, 20 bp, mouse
gagccatgagaaatgactat

SEQ ID NO: 857461 - DNA, 20 bp, mouse
gccttgtgtgacagtggcac

SEQ ID NO: 857462 - DNA, 20 bp, mouse
gggctaatgtaggtactata

SEQ ID NO: 857463 - DNA, 20 bp, mouse
gtgtctctgtagtgctcaga

SEQ ID NO: 857464 - DNA, 20 bp, mouse
ggctacttcattgtttccca

SEQ ID NO: 857465 - DNA, 20 bp, mouse
gctagaatcatcaccttcaa

SEQ ID NO: 857466 - DNA, 20 bp, mouse
gcaaatgaggcgaatgacct

SEQ ID NO: 857467 - DNA, 20 bp, mouse
ggtccaggagacaagttctg

SEQ ID NO: 857468 - DNA, 20 bp, mouse
gcatgaactgacatcaaatg

SEQ ID NO: 857469 - DNA, 20 bp, mouse
gtgacttaggtcattcccag

SEQ ID NO: 857470 - DNA, 20 bp, mouse
ggagcacaacagtagacttc

SEQ ID NO: 857471 - DNA, 20 bp, mouse
gacggactcggggctccgat

SEQ ID NO: 857472 - DNA, 20 bp, mouse
ggagaggctgctctgtcaac

SEQ ID NO: 857473 - DNA, 20 bp, mouse
gttgatgtcagttcatgaac

SEQ ID NO: 857474 - DNA, 20 bp, mouse
gcgaatgacctgggctcctc

SEQ ID NO: 857475 - DNA, 20 bp, mouse
gctgttgctcccgtcagctg

SEQ ID NO: 857476 - DNA, 20 bp, mouse
ggccacagaaaattggtgag

SEQ ID NO: 857477 - DNA, 20 bp, mouse
ggggcaaaggagatccacct

SEQ ID NO: 857478 - DNA, 20 bp, mouse
gcccagctgccacagaaaat

SEQ ID NO: 857479 - DNA, 20 bp, mouse
gcttcccctgaggcaggaga

SEQ ID NO: 857480 - DNA, 20 bp, mouse
gagaaggcacgttccatcct

SEQ ID NO: 857481 - DNA, 20 bp, mouse
gggagaaactccttcccctg

SEQ ID NO: 857482 - DNA, 20 bp, mouse
gtcagtggactgaagcattc

SEQ ID NO: 857483 - DNA, 20 bp, mouse
gttccatcctgggtctatca

SEQ ID NO: 857484 - DNA, 20 bp, mouse
gagaaaattggtgaggggtc

SEQ ID NO: 857485 - DNA, 20 bp, mouse
gtggcagctgggactaccca

SEQ ID NO: 857486 - DNA, 20 bp, mouse
gaacctggaggcaagtgtaa

SEQ ID NO: 857487 - DNA, 20 bp, mouse
gctcccttacacttgcctcc

SEQ ID NO: 857488 - DNA, 20 bp, mouse
gatgccccaaaattggctcc

SEQ ID NO: 857489 - DNA, 20 bp, mouse
gttctgccagcagcttttga

SEQ ID NO: 857490 - DNA, 20 bp, mouse
ggctggggttcattaaggaa

SEQ ID NO: 857491 - DNA, 20 bp, mouse
gtggagtcacaccctacctg

SEQ ID NO: 857492 - DNA, 20 bp, mouse
gggtgcccccaattgtgaaa

SEQ ID NO: 857493 - DNA, 20 bp, mouse
gctctccctctcagctgggc

SEQ ID NO: 857494 - DNA, 20 bp, mouse
gagtgtagtgaaggatgctg

SEQ ID NO: 857495 - DNA, 20 bp, mouse
ggcccccaattgtgaaaggg

SEQ ID NO: 857496 - DNA, 20 bp, mouse
gtaacccagattctgatcgt

SEQ ID NO: 857497 - DNA, 20 bp, mouse
gtgaaccaacgatcagaatc

SEQ ID NO: 857498 - DNA, 20 bp, mouse
gaagcagagggaattcaggt

SEQ ID NO: 857499 - DNA, 20 bp, mouse
ggggctccacccgagattga

SEQ ID NO: 857500 - DNA, 20 bp, mouse
gctgatcgttggttcagatg

SEQ ID NO: 857501 - DNA, 20 bp, mouse
gaccttgaataggaatcacg

SEQ ID NO: 857502 - DNA, 20 bp, mouse
gagagggaattcaggtggga

SEQ ID NO: 857503 - DNA, 20 bp, mouse
gtgcttccctcaatctcggg

SEQ ID NO: 857504 - DNA, 20 bp, mouse
gctctgcttccctcaatctc

SEQ ID NO: 857505 - DNA, 20 bp, mouse
gcaacacattattagacctg

SEQ ID NO: 857506 - DNA, 20 bp, mouse
gagtggggatgagttcagat

SEQ ID NO: 857507 - DNA, 20 bp, mouse
ggttgttggtagagcaagtg

SEQ ID NO: 857508 - DNA, 20 bp, mouse
gtgttatcacatttgaaggt

SEQ ID NO: 857509 - DNA, 20 bp, mouse
gtcagtcatagttcttgtat

SEQ ID NO: 857510 - DNA, 20 bp, mouse
gttgtggtaattctgttcca

SEQ ID NO: 857511 - DNA, 20 bp, mouse
gatcctcccagttgcctcac

SEQ ID NO: 857512 - DNA, 20 bp, mouse
gtcaaaatctgaagttccag

SEQ ID NO: 857513 - DNA, 20 bp, mouse
gtcccagttgcctcacaggc

SEQ ID NO: 857514 - DNA, 20 bp, mouse
gtatatgttatcacatttga

SEQ ID NO: 857515 - DNA, 20 bp, mouse
gtctcagaatgaagtatctt

SEQ ID NO: 857516 - DNA, 20 bp, mouse
ggctgccattaggcacctaa

SEQ ID NO: 857517 - DNA, 20 bp, mouse
gactgctaaggtaataagag

SEQ ID NO: 857518 - DNA, 20 bp, mouse
gtagccaggaagtttatgag

SEQ ID NO: 857519 - DNA, 20 bp, mouse
gcattaagtcatccgttctc

SEQ ID NO: 857520 - DNA, 20 bp, mouse
gccgtggtgtctgtgtgcag

SEQ ID NO: 857521 - DNA, 20 bp, mouse
gtcagcctttaggtgcctaa

SEQ ID NO: 857522 - DNA, 20 bp, mouse
gagacaccacgggaaggcaa

SEQ ID NO: 857523 - DNA, 20 bp, mouse
gctcaggatctgctgccatt

SEQ ID NO: 857524 - DNA, 20 bp, mouse
gtggcatgatgggaaaatgg

SEQ ID NO: 857525 - DNA, 20 bp, mouse
gccttaaaaagtggcatgat

SEQ ID NO: 857526 - DNA, 20 bp, mouse
gagcgggaacacgggaccca

SEQ ID NO: 857527 - DNA, 20 bp, mouse
gacccaaggagaggtgcgaa

SEQ ID NO: 857528 - DNA, 20 bp, mouse
gccgactagagctagagagc

SEQ ID NO: 857529 - DNA, 20 bp, mouse
gagaggtgcgaaaggctcgg

SEQ ID NO: 857530 - DNA, 20 bp, mouse
gctggtggtgtgacgagtaa

SEQ ID NO: 857531 - DNA, 20 bp, mouse
ggagctagagagcgggaaca

SEQ ID NO: 857532 - DNA, 20 bp, mouse
ggaacacgggacccaaggag

SEQ ID NO: 857533 - DNA, 20 bp, mouse
gcggggcaagcgctcgcaga

SEQ ID NO: 857534 - DNA, 20 bp, mouse
ggtgccaagccggaacacgc

SEQ ID NO: 857535 - DNA, 20 bp, mouse
gagccgccgccaccgtcctt

SEQ ID NO: 857536 - DNA, 20 bp, mouse
gggaatatcattgtgaaagc

SEQ ID NO: 857537 - DNA, 20 bp, mouse
gagttcctgattcaatccca

SEQ ID NO: 857538 - DNA, 20 bp, mouse
gtgacttctagctgggtgca

SEQ ID NO: 857539 - DNA, 20 bp, mouse
gttcatgtagtgatgaaaat

SEQ ID NO: 857540 - DNA, 20 bp, mouse
gaatctctgcttttgtttag

SEQ ID NO: 857541 - DNA, 20 bp, mouse
ggccttgaaaggcatcccca

SEQ ID NO: 857542 - DNA, 20 bp, mouse
gaagctgggactcatgcctt

SEQ ID NO: 857543 - DNA, 20 bp, mouse
gttggggataactgtacagg

SEQ ID NO: 857544 - DNA, 20 bp, mouse
gctttccaatgagaagtcat

SEQ ID NO: 857545 - DNA, 20 bp, mouse
gttcttggggataactgtac

SEQ ID NO: 857546 - DNA, 20 bp, mouse
gccgcggcccgctcctgcgc

SEQ ID NO: 857547 - DNA, 20 bp, mouse
ggtcccgcgacgcgtcctcc

SEQ ID NO: 857548 - DNA, 20 bp, mouse
ggaaagaggcggtcgcctat

SEQ ID NO: 857549 - DNA, 20 bp, mouse
gacccgggaggacgcgtcgc

SEQ ID NO: 857550 - DNA, 20 bp, mouse
gagcgtgcgtcctgattgtg

SEQ ID NO: 857551 - DNA, 20 bp, mouse
gtcctgcgccgggaaagagg

SEQ ID NO: 857552 - DNA, 20 bp, mouse
ggcgccgtagcctcacaatc

SEQ ID NO: 857553 - DNA, 20 bp, mouse
gacgcacgctgctgacgtca

SEQ ID NO: 857554 - DNA, 20 bp, mouse
gcgctcctgcgccgggaaag

SEQ ID NO: 857555 - DNA, 20 bp, mouse
gaccgcctctttcccggcgc

SEQ ID NO: 857556 - DNA, 20 bp, mouse
gcgaagcagagcctcaggac

SEQ ID NO: 857557 - DNA, 20 bp, mouse
gctggggcgagcaataaggt

SEQ ID NO: 857558 - DNA, 20 bp, mouse
gcgcagaggcggaagtgact

SEQ ID NO: 857559 - DNA, 20 bp, mouse
gcctgctcaggagctcggta

SEQ ID NO: 857560 - DNA, 20 bp, mouse
gaggcccccgcggctccggt

SEQ ID NO: 857561 - DNA, 20 bp, mouse
gctcctgagcaggcgttgtg

SEQ ID NO: 857562 - DNA, 20 bp, mouse
ggggcgagcaataaggtggg

SEQ ID NO: 857563 - DNA, 20 bp, mouse
gaggcggaagtgactcggcg

SEQ ID NO: 857564 - DNA, 20 bp, mouse
ggccgaaggaccctagagaa

SEQ ID NO: 857565 - DNA, 20 bp, mouse
ggctcgccccagtaaaccct

SEQ ID NO: 857566 - DNA, 20 bp, mouse
gctaacggagcgggagagtg

SEQ ID NO: 857567 - DNA, 20 bp, mouse
gggccagtgcgtggtgggaa

SEQ ID NO: 857568 - DNA, 20 bp, mouse
gtgtcccgcagtgataatgg

SEQ ID NO: 857569 - DNA, 20 bp, mouse
gaaaggaaggagaatataac

SEQ ID NO: 857570 - DNA, 20 bp, mouse
gtaaacggatgacctagact

SEQ ID NO: 857571 - DNA, 20 bp, mouse
gtgccgctggagccggtgtc

SEQ ID NO: 857572 - DNA, 20 bp, mouse
gttgacctagcgtatgaggt

SEQ ID NO: 857573 - DNA, 20 bp, mouse
ggagaggcggggccagtgcg

SEQ ID NO: 857574 - DNA, 20 bp, mouse
gaagcggaagtgacgttaaa

SEQ ID NO: 857575 - DNA, 20 bp, mouse
ggcggggccggctggttgca

SEQ ID NO: 857576 - DNA, 20 bp, mouse
gtgccagcaccggcatggag

SEQ ID NO: 857577 - DNA, 20 bp, mouse
gggagcactcccactgcagg

SEQ ID NO: 857578 - DNA, 20 bp, mouse
gtgagctgccagcaccggca

SEQ ID NO: 857579 - DNA, 20 bp, mouse
gacaagcctgccccggctca

SEQ ID NO: 857580 - DNA, 20 bp, mouse
gcacccctccatgccggtgc

SEQ ID NO: 857581 - DNA, 20 bp, mouse
gcacccacataaacaagccc

SEQ ID NO: 857582 - DNA, 20 bp, mouse
gcacataaacaagcccggga

SEQ ID NO: 857583 - DNA, 20 bp, mouse
gggcaggcttgtctcactgc

SEQ ID NO: 857584 - DNA, 20 bp, mouse
gtgctggcagctcaccttcc

SEQ ID NO: 857585 - DNA, 20 bp, mouse
gtgtctccgccccctgcagt

SEQ ID NO: 857586 - DNA, 20 bp, mouse
ggattcttaaacttcgtctg

SEQ ID NO: 857587 - DNA, 20 bp, mouse
gcgtctggggcgctcatggg

SEQ ID NO: 857588 - DNA, 20 bp, mouse
gagggaccggagttaagtgc

SEQ ID NO: 857589 - DNA, 20 bp, mouse
gcaggggaacgggatctgtt

SEQ ID NO: 857590 - DNA, 20 bp, mouse
gccctcccatctaaattcca

SEQ ID NO: 857591 - DNA, 20 bp, mouse
gtaggtcccgcctctctccg

SEQ ID NO: 857592 - DNA, 20 bp, mouse
ggcgctcatgggtggagccg

SEQ ID NO: 857593 - DNA, 20 bp, mouse
gggaacgggatctgttcggc

SEQ ID NO: 857594 - DNA, 20 bp, mouse
ggagttaagtgcaggggaac

SEQ ID NO: 857595 - DNA, 20 bp, mouse
gtgggcaaggggcggtgcta

SEQ ID NO: 857596 - DNA, 20 bp, mouse
gcgcgtagatggagaagctc

SEQ ID NO: 857597 - DNA, 20 bp, mouse
gctgggtggggtaaggaaga

SEQ ID NO: 857598 - DNA, 20 bp, mouse
gttcaggtaaggggataaag

SEQ ID NO: 857599 - DNA, 20 bp, mouse
gttaccccacccagactggg

SEQ ID NO: 857600 - DNA, 20 bp, mouse
gaggacatggagctaaactg

SEQ ID NO: 857601 - DNA, 20 bp, mouse
gacagactgatgcccttttg

SEQ ID NO: 857602 - DNA, 20 bp, mouse
gcacccagactgggaggtga

SEQ ID NO: 857603 - DNA, 20 bp, mouse
ggaggtgaagggttaattcc

SEQ ID NO: 857604 - DNA, 20 bp, mouse
gaggagccagaaacaaacca

SEQ ID NO: 857605 - DNA, 20 bp, mouse
gcctgccccaggtggatttg

SEQ ID NO: 857606 - DNA, 20 bp, mouse
gtgctcccagagccactcta

SEQ ID NO: 857607 - DNA, 20 bp, mouse
gatgacttccggttcctggg

SEQ ID NO: 857608 - DNA, 20 bp, mouse
ggccacggagttccactcag

SEQ ID NO: 857609 - DNA, 20 bp, mouse
gagtggctctgggagcaaca

SEQ ID NO: 857610 - DNA, 20 bp, mouse
gaccactgagtggaactccg

SEQ ID NO: 857611 - DNA, 20 bp, mouse
gtctcaaagagacattcttc

SEQ ID NO: 857612 - DNA, 20 bp, mouse
gtggctccctagagtggctc

SEQ ID NO: 857613 - DNA, 20 bp, mouse
gtcatcgcggactcccacaa

SEQ ID NO: 857614 - DNA, 20 bp, mouse
gcgcgaaaccggataaggac

SEQ ID NO: 857615 - DNA, 20 bp, mouse
gtgaaacacaaacgcgaaac

SEQ ID NO: 857616 - DNA, 20 bp, mouse
gtcatctaggtgtatagctg

SEQ ID NO: 857617 - DNA, 20 bp, mouse
gtgagatccttcttgttttg

SEQ ID NO: 857618 - DNA, 20 bp, mouse
gaaactactagatctcgggc

SEQ ID NO: 857619 - DNA, 20 bp, mouse
gacatctaagtctttattat

SEQ ID NO: 857620 - DNA, 20 bp, mouse
gtatagtgatatggtatttt

SEQ ID NO: 857621 - DNA, 20 bp, mouse
gttgtatggtacattcatct

SEQ ID NO: 857622 - DNA, 20 bp, mouse
gccaacaaaattgtactgac

SEQ ID NO: 857623 - DNA, 20 bp, mouse
gattaaaactactagatctc

SEQ ID NO: 857624 - DNA, 20 bp, mouse
gcttagatgttatagtgata

SEQ ID NO: 857625 - DNA, 20 bp, mouse
gtgaatttactgatattgta

SEQ ID NO: 857626 - DNA, 20 bp, mouse
ggatccggaggcattactta

SEQ ID NO: 857627 - DNA, 20 bp, mouse
gcacccccccccccgtctct

SEQ ID NO: 857628 - DNA, 20 bp, mouse
gaagacagacagctagtcct

SEQ ID NO: 857629 - DNA, 20 bp, mouse
gagtaatgcctccggatcag

SEQ ID NO: 857630 - DNA, 20 bp, mouse
ggtagtttacccagagacgg

SEQ ID NO: 857631 - DNA, 20 bp, mouse
gactgcgtccagatgggcgt

SEQ ID NO: 857632 - DNA, 20 bp, mouse
gttacccagagacggggggg

SEQ ID NO: 857633 - DNA, 20 bp, mouse
ggtgaaaactgcgtccagat

SEQ ID NO: 857634 - DNA, 20 bp, mouse
ggtccagatgggcgttggga

SEQ ID NO: 857635 - DNA, 20 bp, mouse
ggacgggagaggcccgccca

SEQ ID NO: 857636 - DNA, 20 bp, mouse
ggagaagatgaggcactcat

SEQ ID NO: 857637 - DNA, 20 bp, mouse
gccggtggccactcctctat

SEQ ID NO: 857638 - DNA, 20 bp, mouse
gttgcagggccaatgcctgg

SEQ ID NO: 857639 - DNA, 20 bp, mouse
gggccctgcaagatttgttc

SEQ ID NO: 857640 - DNA, 20 bp, mouse
gttagaagggcgtggggtcg

SEQ ID NO: 857641 - DNA, 20 bp, mouse
gtctgagaggcggccgatag

SEQ ID NO: 857642 - DNA, 20 bp, mouse
ggaggcggccgatagaggag

SEQ ID NO: 857643 - DNA, 20 bp, mouse
gggtggagtctagattagaa

SEQ ID NO: 857644 - DNA, 20 bp, mouse
gaccgtcaccgcagaaccaa

SEQ ID NO: 857645 - DNA, 20 bp, mouse
gcagagcgcctgagaagatg

SEQ ID NO: 857646 - DNA, 20 bp, mouse
gagagccccgcccctctgga

SEQ ID NO: 857647 - DNA, 20 bp, mouse
gctaggaatccgagcgttgt

SEQ ID NO: 857648 - DNA, 20 bp, mouse
gtcgcagcctccggtgaaac

SEQ ID NO: 857649 - DNA, 20 bp, mouse
gccggaggctgcgactgtcc

SEQ ID NO: 857650 - DNA, 20 bp, mouse
ggctcggattcctagagggg

SEQ ID NO: 857651 - DNA, 20 bp, mouse
gtgctccccctccagagggg

SEQ ID NO: 857652 - DNA, 20 bp, mouse
gcggtatcctgtttcaccgg

SEQ ID NO: 857653 - DNA, 20 bp, mouse
gtgtcggtatcctgtttcac

SEQ ID NO: 857654 - DNA, 20 bp, mouse
gggctctgacgcgcttccgg

SEQ ID NO: 857655 - DNA, 20 bp, mouse
gttggagggttatgcggccc

SEQ ID NO: 857656 - DNA, 20 bp, mouse
gtgggaaggatggtgactct

SEQ ID NO: 857657 - DNA, 20 bp, mouse
gtgaatgcctgccgggggtt

SEQ ID NO: 857658 - DNA, 20 bp, mouse
gagcacagcgctaattcttt

SEQ ID NO: 857659 - DNA, 20 bp, mouse
gagtgaggtccatcctctga

SEQ ID NO: 857660 - DNA, 20 bp, mouse
gagagggtaccaaaactcct

SEQ ID NO: 857661 - DNA, 20 bp, mouse
gtgcctgccgggggttgggt

SEQ ID NO: 857662 - DNA, 20 bp, mouse
gggccacacagcacgtcacc

SEQ ID NO: 857663 - DNA, 20 bp, mouse
gtgtgggatgtgtgggaagt

SEQ ID NO: 857664 - DNA, 20 bp, mouse
ggttgtgagccatcagagga

SEQ ID NO: 857665 - DNA, 20 bp, mouse
gaaggatggtgactctaggc

SEQ ID NO: 857666 - DNA, 20 bp, mouse
gaagcccaagccagttgata

SEQ ID NO: 857667 - DNA, 20 bp, mouse
gaaaccctatcaactggctt

SEQ ID NO: 857668 - DNA, 20 bp, mouse
gcttgggcttagatcagtca

SEQ ID NO: 857669 - DNA, 20 bp, mouse
gagcagtgcagtaacctgta

SEQ ID NO: 857670 - DNA, 20 bp, mouse
ggggcttagatcagtcaggg

SEQ ID NO: 857671 - DNA, 20 bp, mouse
gaaaccaacaaatacactag

SEQ ID NO: 857672 - DNA, 20 bp, mouse
gtggcatggtatttaccctg

SEQ ID NO: 857673 - DNA, 20 bp, mouse
gaagccactagtgtatttgt

SEQ ID NO: 857674 - DNA, 20 bp, mouse
gctgtcaggccattccttac

SEQ ID NO: 857675 - DNA, 20 bp, mouse
gggtaaataccatgccatac

SEQ ID NO: 857676 - DNA, 20 bp, mouse
gaccctgcgaccagggcgag

SEQ ID NO: 857677 - DNA, 20 bp, mouse
gggaccaggactcaactcgg

SEQ ID NO: 857678 - DNA, 20 bp, mouse
gtgaaaacagtcaaacgaaa

SEQ ID NO: 857679 - DNA, 20 bp, mouse
gagcggagccggaaactact

SEQ ID NO: 857680 - DNA, 20 bp, mouse
gtcctcccatcgtcctagag

SEQ ID NO: 857681 - DNA, 20 bp, mouse
ggagccggaaactactgggc

SEQ ID NO: 857682 - DNA, 20 bp, mouse
gaaagctggcatgatcatgt

SEQ ID NO: 857683 - DNA, 20 bp, mouse
ggaacttggtggcaaaaggg

SEQ ID NO: 857684 - DNA, 20 bp, mouse
ggtgactgaccctgcgacca

SEQ ID NO: 857685 - DNA, 20 bp, mouse
gcactagaataacaaagctc

SEQ ID NO: 857686 - DNA, 20 bp, mouse
ggaccctgggtacccactca

SEQ ID NO: 857687 - DNA, 20 bp, mouse
gcctgggccgcgcgcacttc

SEQ ID NO: 857688 - DNA, 20 bp, mouse
gtgtgaggggtcgcccggag

SEQ ID NO: 857689 - DNA, 20 bp, mouse
gggcgacccctcacacccag

SEQ ID NO: 857690 - DNA, 20 bp, mouse
gcagggcaagagattccgct

SEQ ID NO: 857691 - DNA, 20 bp, mouse
gcggacttccggcttgagag

SEQ ID NO: 857692 - DNA, 20 bp, mouse
gcggtggactgcggggattc

SEQ ID NO: 857693 - DNA, 20 bp, mouse
ggtggcatctcctctcccgg

SEQ ID NO: 857694 - DNA, 20 bp, mouse
gccccgcagtccaccgggag

SEQ ID NO: 857695 - DNA, 20 bp, mouse
ggccgtcgcgcatgcgtcct

SEQ ID NO: 857696 - DNA, 20 bp, mouse
gtgcccttttaggggtgttt

SEQ ID NO: 857697 - DNA, 20 bp, mouse
gggtgctcgcgtgccggaag

SEQ ID NO: 857698 - DNA, 20 bp, mouse
gcaaaggactactttttcta

SEQ ID NO: 857699 - DNA, 20 bp, mouse
gtatggccagatcaatttga

SEQ ID NO: 857700 - DNA, 20 bp, mouse
ggctgcatgtgcccttttag

SEQ ID NO: 857701 - DNA, 20 bp, mouse
ggcccctctaggaaacccaa

SEQ ID NO: 857702 - DNA, 20 bp, mouse
gtcagtgaaggacagaacta

SEQ ID NO: 857703 - DNA, 20 bp, mouse
gggaacgagcttgcccctct

SEQ ID NO: 857704 - DNA, 20 bp, mouse
gctcgaaagaacatgagtgt

SEQ ID NO: 857705 - DNA, 20 bp, mouse
ggcaagctcgttcccacttc

SEQ ID NO: 857706 - DNA, 20 bp, mouse
gtcctggtttccagagagat

SEQ ID NO: 857707 - DNA, 20 bp, mouse
gaaaacttgttaaaatttcc

SEQ ID NO: 857708 - DNA, 20 bp, mouse
gtccaatctctctggaaacc

SEQ ID NO: 857709 - DNA, 20 bp, mouse
gctgctgattgaatcatgta

SEQ ID NO: 857710 - DNA, 20 bp, mouse
gaaagtaatagtagttgaat

SEQ ID NO: 857711 - DNA, 20 bp, mouse
gtgccccacccagggacagg

SEQ ID NO: 857712 - DNA, 20 bp, mouse
gccaaggtcagtctgaccta

SEQ ID NO: 857713 - DNA, 20 bp, mouse
gtacaagcaagcacacaaat

SEQ ID NO: 857714 - DNA, 20 bp, mouse
gctatcaaacctcctgtccc

SEQ ID NO: 857715 - DNA, 20 bp, mouse
gcaaacctcctgtccctggg

SEQ ID NO: 857716 - DNA, 20 bp, mouse
gaaaacttgttaaaatttcc

SEQ ID NO: 857717 - DNA, 20 bp, mouse
gtcctggtttctagagagat

SEQ ID NO: 857718 - DNA, 20 bp, mouse
gtccaatctctctagaaacc

SEQ ID NO: 857719 - DNA, 20 bp, mouse
gttggcattatctgttcctc

SEQ ID NO: 857720 - DNA, 20 bp, mouse
gcaaaactcctgttcctggg

SEQ ID NO: 857721 - DNA, 20 bp, mouse
gtatcaaaactcctgttcct

SEQ ID NO: 857722 - DNA, 20 bp, mouse
gcaagcaagcaaacaaaata

SEQ ID NO: 857723 - DNA, 20 bp, mouse
gtgtatttgattcccccttt

SEQ ID NO: 857724 - DNA, 20 bp, mouse
ggactactatgtgagaacac

SEQ ID NO: 857725 - DNA, 20 bp, mouse
gtaactgactaacggaagcc

SEQ ID NO: 857726 - DNA, 20 bp, mouse
gaaccgactaacggaagcca

SEQ ID NO: 857727 - DNA, 20 bp, mouse
ggaaactcgttaaaatttcc

SEQ ID NO: 857728 - DNA, 20 bp, mouse
ggttctcacatagtagtcaa

SEQ ID NO: 857729 - DNA, 20 bp, mouse
ggtcatcagtaaccgactaa

SEQ ID NO: 857730 - DNA, 20 bp, mouse
gaaatagtaccacacttaag

SEQ ID NO: 857731 - DNA, 20 bp, mouse
gtgccccacccagggacagg

SEQ ID NO: 857732 - DNA, 20 bp, mouse
gccaaggtcagtctgaccta

SEQ ID NO: 857733 - DNA, 20 bp, mouse
gctatcaaacctcctgtccc

SEQ ID NO: 857734 - DNA, 20 bp, mouse
gcaaacctcctgtccctggg

SEQ ID NO: 857735 - DNA, 20 bp, mouse
ggactactatgtgagaacac

SEQ ID NO: 857736 - DNA, 20 bp, mouse
gtcctggtttccagagagat

SEQ ID NO: 857737 - DNA, 20 bp, mouse
gaaaacttgttaaaatttcc

SEQ ID NO: 857738 - DNA, 20 bp, mouse
gtccaatctctctggaaacc

SEQ ID NO: 857739 - DNA, 20 bp, mouse
gtgccccacccagggacagg

SEQ ID NO: 857740 - DNA, 20 bp, mouse
gccaaggtcagtctgaccta

SEQ ID NO: 857741 - DNA, 20 bp, mouse
gtacaagcaagcacacaaat

SEQ ID NO: 857742 - DNA, 20 bp, mouse
gctatcaaacctcctgtccc

SEQ ID NO: 857743 - DNA, 20 bp, mouse
gcaaacctcctgtccctggg

SEQ ID NO: 857744 - DNA, 20 bp, mouse
gtggtaatctgccccaccca

SEQ ID NO: 857745 - DNA, 20 bp, mouse
ggactactatgtgagaacac

SEQ ID NO: 857746 - DNA, 20 bp, mouse
ggcaaatctagagctgactt

SEQ ID NO: 857747 - DNA, 20 bp, mouse
ggaaacttgttacaatttcc

SEQ ID NO: 857748 - DNA, 20 bp, mouse
ggttctcacatagtagtcaa

SEQ ID NO: 857749 - DNA, 20 bp, mouse
gaaaactccttttcctgggt

SEQ ID NO: 857750 - DNA, 20 bp, mouse
gcaagcaagcaaacaaaata

SEQ ID NO: 857751 - DNA, 20 bp, mouse
gttggcattatctgttcctc

SEQ ID NO: 857752 - DNA, 20 bp, mouse
gctatcaaaactccttttcc

SEQ ID NO: 857753 - DNA, 20 bp, mouse
gatctgccccacccaggaaa

SEQ ID NO: 857754 - DNA, 20 bp, mouse
ggaagccaggcgctataaaa

SEQ ID NO: 857755 - DNA, 20 bp, mouse
ggactactatgtgagaacac

SEQ ID NO: 857756 - DNA, 20 bp, mouse
gccagggcgtggtcatgata

SEQ ID NO: 857757 - DNA, 20 bp, mouse
gatgatacgggctactgggg

SEQ ID NO: 857758 - DNA, 20 bp, mouse
ggtcatgatacgggctactg

SEQ ID NO: 857759 - DNA, 20 bp, mouse
gctaccataaatctattcgc

SEQ ID NO: 857760 - DNA, 20 bp, mouse
gctctgggcagactagtaac

SEQ ID NO: 857761 - DNA, 20 bp, mouse
gaacccggcgaatagattta

SEQ ID NO: 857762 - DNA, 20 bp, mouse
ggagcatcggaactgtcttc

SEQ ID NO: 857763 - DNA, 20 bp, mouse
gtggatgtcattttagaacc

SEQ ID NO: 857764 - DNA, 20 bp, mouse
gtaaaatgacatccaatctc

SEQ ID NO: 857765 - DNA, 20 bp, mouse
gttattaaattaccagggcg

SEQ ID NO: 857766 - DNA, 20 bp, mouse
gaccccccgtacatattgtt

SEQ ID NO: 857767 - DNA, 20 bp, mouse
gtacggggggtatgtttata

SEQ ID NO: 857768 - DNA, 20 bp, mouse
gctgggaggcaagaaaaaag

SEQ ID NO: 857769 - DNA, 20 bp, mouse
gtaaatctggggtgcttatg

SEQ ID NO: 857770 - DNA, 20 bp, mouse
gggtaggccagtttacacag

SEQ ID NO: 857771 - DNA, 20 bp, mouse
gggcacacacccttaaatct

SEQ ID NO: 857772 - DNA, 20 bp, mouse
gtggggtgcttatgaggcag

SEQ ID NO: 857773 - DNA, 20 bp, mouse
gttcctaacaatatgtacgg

SEQ ID NO: 857774 - DNA, 20 bp, mouse
gataaggaatcgtgaaatct

SEQ ID NO: 857775 - DNA, 20 bp, mouse
gaactcattccgtgtagaca

SEQ ID NO: 857776 - DNA, 20 bp, mouse
gccctcgggcggcctgttcc

SEQ ID NO: 857777 - DNA, 20 bp, mouse
gaagcctcccttcggtctag

SEQ ID NO: 857778 - DNA, 20 bp, mouse
ggggaggcttcgccctcggg

SEQ ID NO: 857779 - DNA, 20 bp, mouse
gaccaatgagagcttgtgga

SEQ ID NO: 857780 - DNA, 20 bp, mouse
gggactggcagctcctggac

SEQ ID NO: 857781 - DNA, 20 bp, mouse
gtccagccccctagaccgaa

SEQ ID NO: 857782 - DNA, 20 bp, mouse
ggaaaggcggcaccttttaa

SEQ ID NO: 857783 - DNA, 20 bp, mouse
ggggagttacggaccaatcc

SEQ ID NO: 857784 - DNA, 20 bp, mouse
ggaagggaggcttcgccctc

SEQ ID NO: 857785 - DNA, 20 bp, mouse
gggagctgccagtccaggat

SEQ ID NO: 857786 - DNA, 20 bp, mouse
gcagctgtgcctgtgacctc

SEQ ID NO: 857787 - DNA, 20 bp, mouse
gagggctagtacaccctcta

SEQ ID NO: 857788 - DNA, 20 bp, mouse
gctactgcagggtagctctc

SEQ ID NO: 857789 - DNA, 20 bp, mouse
gcacaacagcatgcaattag

SEQ ID NO: 857790 - DNA, 20 bp, mouse
ggcgtgcagcgcggttgctg

SEQ ID NO: 857791 - DNA, 20 bp, mouse
gaaaaaaaaactcaccacga

SEQ ID NO: 857792 - DNA, 20 bp, mouse
gcttagatccagttacagtg

SEQ ID NO: 857793 - DNA, 20 bp, mouse
gtgtgtctgtatggtcgtgt

SEQ ID NO: 857794 - DNA, 20 bp, mouse
ggcggttgctgcggtaacgg

SEQ ID NO: 857795 - DNA, 20 bp, mouse
gagcgcggttgctgcggtaa

SEQ ID NO: 857796 - DNA, 20 bp, mouse
gcaggggccggaaatcccaa

SEQ ID NO: 857797 - DNA, 20 bp, mouse
ggcgagacgcagattgtgat

SEQ ID NO: 857798 - DNA, 20 bp, mouse
gcttccggaaggtcgctcca

SEQ ID NO: 857799 - DNA, 20 bp, mouse
ggaaacgcggaaacttatat

SEQ ID NO: 857800 - DNA, 20 bp, mouse
gtgcttgtcaatttcagagt

SEQ ID NO: 857801 - DNA, 20 bp, mouse
gggcccctggagcgaccttc

SEQ ID NO: 857802 - DNA, 20 bp, mouse
gggctcccagcgcttccgga

SEQ ID NO: 857803 - DNA, 20 bp, mouse
gtgattgggtgaatcagcga

SEQ ID NO: 857804 - DNA, 20 bp, mouse
gggaaatcccaagggctccg

SEQ ID NO: 857805 - DNA, 20 bp, mouse
ggctgcggttgagagaaacg

SEQ ID NO: 857806 - DNA, 20 bp, mouse
gctagagggccggcccaaag

SEQ ID NO: 857807 - DNA, 20 bp, mouse
gccccagccgccaggctaga

SEQ ID NO: 857808 - DNA, 20 bp, mouse
gcggcccaaaggggcggaga

SEQ ID NO: 857809 - DNA, 20 bp, mouse
gtcttcttgcgacctcttat

SEQ ID NO: 857810 - DNA, 20 bp, mouse
gaagagtcgctgtccatcac

SEQ ID NO: 857811 - DNA, 20 bp, mouse
gggctcataccgccccgtga

SEQ ID NO: 857812 - DNA, 20 bp, mouse
gggggttccctcattttgat

SEQ ID NO: 857813 - DNA, 20 bp, mouse
gtggccttgtgaggagtttc

SEQ ID NO: 857814 - DNA, 20 bp, mouse
gcctcacaaggccaagccgt

SEQ ID NO: 857815 - DNA, 20 bp, mouse
gggccggccctctagcctgg

SEQ ID NO: 857816 - DNA, 20 bp, mouse
gcgggcgcgaggagacgcgg

SEQ ID NO: 857817 - DNA, 20 bp, mouse
gcgcccgcggcggccccgga

SEQ ID NO: 857818 - DNA, 20 bp, mouse
gcgggggcgagcacagactg

SEQ ID NO: 857819 - DNA, 20 bp, mouse
gaggcgacgcgcgccgtccg

SEQ ID NO: 857820 - DNA, 20 bp, mouse
gtcgcctcgcgctggtcctc

SEQ ID NO: 857821 - DNA, 20 bp, mouse
gcaaccagcgccggcccgag

SEQ ID NO: 857822 - DNA, 20 bp, mouse
gccgcgcaagcgcccagcgg

SEQ ID NO: 857823 - DNA, 20 bp, mouse
gagcgctcggattgtgttcc

SEQ ID NO: 857824 - DNA, 20 bp, mouse
ggcttgaggggcatgaggag

SEQ ID NO: 857825 - DNA, 20 bp, mouse
gagcggcgcgagcacgggac

SEQ ID NO: 857826 - DNA, 20 bp, mouse
gccgaggaggagcgccgata

SEQ ID NO: 857827 - DNA, 20 bp, mouse
gagggagaacctaggggagg

SEQ ID NO: 857828 - DNA, 20 bp, mouse
gagggcccgccgctccttgt

SEQ ID NO: 857829 - DNA, 20 bp, mouse
gcgccgatagggagaaccta

SEQ ID NO: 857830 - DNA, 20 bp, mouse
gcccaccgggcacccaaccc

SEQ ID NO: 857831 - DNA, 20 bp, mouse
gtcccctaggttctccctat

SEQ ID NO: 857832 - DNA, 20 bp, mouse
gtgtaggggcacgggaggtg

SEQ ID NO: 857833 - DNA, 20 bp, mouse
ggggaggcggggctcaggcg

SEQ ID NO: 857834 - DNA, 20 bp, mouse
gaggagcggcgggccctaga

SEQ ID NO: 857835 - DNA, 20 bp, mouse
gcggggcctatgcaaatcac

SEQ ID NO: 857836 - DNA, 20 bp, mouse
gcggactggcggggcgtccc

SEQ ID NO: 857837 - DNA, 20 bp, mouse
gaggacccgtcggcatgttc

SEQ ID NO: 857838 - DNA, 20 bp, mouse
gtctctgagggaggacccgt

SEQ ID NO: 857839 - DNA, 20 bp, mouse
gtctgggtcgaaccctgctg

SEQ ID NO: 857840 - DNA, 20 bp, mouse
gtggcttagtggatctctga

SEQ ID NO: 857841 - DNA, 20 bp, mouse
ggccgcgggccggcggtgtg

SEQ ID NO: 857842 - DNA, 20 bp, mouse
gcgggccagccgtggcttag

SEQ ID NO: 857843 - DNA, 20 bp, mouse
gcagacgccagcgaagcaac

SEQ ID NO: 857844 - DNA, 20 bp, mouse
gcggcggtgtgggggttgta

SEQ ID NO: 857845 - DNA, 20 bp, mouse
gcgtcatcgcgcatgcggac

SEQ ID NO: 857846 - DNA, 20 bp, mouse
ggggaccgtgcagtgaccat

SEQ ID NO: 857847 - DNA, 20 bp, mouse
ggacccgttcctattccttt

SEQ ID NO: 857848 - DNA, 20 bp, mouse
gtgaacggtgtccacttctt

SEQ ID NO: 857849 - DNA, 20 bp, mouse
gctcccaaaggaataggaac

SEQ ID NO: 857850 - DNA, 20 bp, mouse
gcgcgtacgggcgggtgtag

SEQ ID NO: 857851 - DNA, 20 bp, mouse
gccctcgcgtgctcgaggac

SEQ ID NO: 857852 - DNA, 20 bp, mouse
ggactggaccgcgtacgggc

SEQ ID NO: 857853 - DNA, 20 bp, mouse
gacttctttggggacactat

SEQ ID NO: 857854 - DNA, 20 bp, mouse
gcgaggactggaccgcgtac

SEQ ID NO: 857855 - DNA, 20 bp, mouse
ggcgagggcggaagtagtga

SEQ ID NO: 857856 - DNA, 20 bp, mouse
gggaaactgcaactggaagg

SEQ ID NO: 857857 - DNA, 20 bp, mouse
gctggagtggaaactgcaac

SEQ ID NO: 857858 - DNA, 20 bp, mouse
gatactgtgtaaacaggaac

SEQ ID NO: 857859 - DNA, 20 bp, mouse
gagtggaaactgcaactgga

SEQ ID NO: 857860 - DNA, 20 bp, mouse
gagctctaaattatgttctg

SEQ ID NO: 857861 - DNA, 20 bp, mouse
gtgcagatccgtctgagttg

SEQ ID NO: 857862 - DNA, 20 bp, mouse
ggttacggttttagcatatc

SEQ ID NO: 857863 - DNA, 20 bp, mouse
ggatctgcagcggggcatgc

SEQ ID NO: 857864 - DNA, 20 bp, mouse
gggttttagcatatctggag

SEQ ID NO: 857865 - DNA, 20 bp, mouse
gacggacgtgtttaaatatg

SEQ ID NO: 857866 - DNA, 20 bp, mouse
gggcgctcgcgcacaggaga

SEQ ID NO: 857867 - DNA, 20 bp, mouse
gtgacggcgcgaggcctcct

SEQ ID NO: 857868 - DNA, 20 bp, mouse
gcaggcgtccgctgtttcag

SEQ ID NO: 857869 - DNA, 20 bp, mouse
ggggtccggcgctcgcgcac

SEQ ID NO: 857870 - DNA, 20 bp, mouse
gagaaggcaccaaagtgcgc

SEQ ID NO: 857871 - DNA, 20 bp, mouse
gctagacgccactgaaacag

SEQ ID NO: 857872 - DNA, 20 bp, mouse
gaaaaccggcgggaacagac

SEQ ID NO: 857873 - DNA, 20 bp, mouse
ggggtcacactacagttccc

SEQ ID NO: 857874 - DNA, 20 bp, mouse
gtcgagctagataatctcac

SEQ ID NO: 857875 - DNA, 20 bp, mouse
gagtatagggagggccataa

SEQ ID NO: 857876 - DNA, 20 bp, mouse
gcggctatagaggagggcga

SEQ ID NO: 857877 - DNA, 20 bp, mouse
ggcctctgacgtcattgtct

SEQ ID NO: 857878 - DNA, 20 bp, mouse
gacctccactcaccatgacg

SEQ ID NO: 857879 - DNA, 20 bp, mouse
ggcccagacaatgacgtcag

SEQ ID NO: 857880 - DNA, 20 bp, mouse
gggggggcggctatagagga

SEQ ID NO: 857881 - DNA, 20 bp, mouse
gaaaagagatgttatgatga

SEQ ID NO: 857882 - DNA, 20 bp, mouse
ggagatgttatgatgagggt

SEQ ID NO: 857883 - DNA, 20 bp, mouse
gttaaagcgtgaagtagttc

SEQ ID NO: 857884 - DNA, 20 bp, mouse
gtctcccatttctgttaggg

SEQ ID NO: 857885 - DNA, 20 bp, mouse
ggatgcggaagacgagtgga

SEQ ID NO: 857886 - DNA, 20 bp, mouse
ggcgggaccggaatcgactc

SEQ ID NO: 857887 - DNA, 20 bp, mouse
ggactccggccaatgaaaag

SEQ ID NO: 857888 - DNA, 20 bp, mouse
gtacgcttgcgtacgggggc

SEQ ID NO: 857889 - DNA, 20 bp, mouse
gaggcggtttttcggttctg

SEQ ID NO: 857890 - DNA, 20 bp, mouse
gccccgtacgcaagcgtagg

SEQ ID NO: 857891 - DNA, 20 bp, mouse
gtcagtgcttcctactgcgc

SEQ ID NO: 857892 - DNA, 20 bp, mouse
gcttcagcgtcgtggaggag

SEQ ID NO: 857893 - DNA, 20 bp, mouse
gaataggaaagcgtgactac

SEQ ID NO: 857894 - DNA, 20 bp, mouse
ggcaagcgtaggcggttttt

SEQ ID NO: 857895 - DNA, 20 bp, mouse
gtgcccgcctaggtcgagat

SEQ ID NO: 857896 - DNA, 20 bp, mouse
gtgtgtgcacatgtgctgtg

SEQ ID NO: 857897 - DNA, 20 bp, mouse
gcgggcatctagatcagaaa

SEQ ID NO: 857898 - DNA, 20 bp, mouse
ggaagttactgtgagctctc

SEQ ID NO: 857899 - DNA, 20 bp, mouse
ggtagtagagtatttaacgt

SEQ ID NO: 857900 - DNA, 20 bp, mouse
ggacccagggtgaggaggta

SEQ ID NO: 857901 - DNA, 20 bp, mouse
gtgcctgggcagcagcattc

SEQ ID NO: 857902 - DNA, 20 bp, mouse
gatgagttgttctctctcat

SEQ ID NO: 857903 - DNA, 20 bp, mouse
gaggaagaggccacagcaac

SEQ ID NO: 857904 - DNA, 20 bp, mouse
gcgtgttacaaagtaatcaa

SEQ ID NO: 857905 - DNA, 20 bp, mouse
gtgtcattctgtgtctactt

SEQ ID NO: 857906 - DNA, 20 bp, mouse
ggcgcaggagccgtgggcgt

SEQ ID NO: 857907 - DNA, 20 bp, mouse
ggtggcgcgcgagggctgtc

SEQ ID NO: 857908 - DNA, 20 bp, mouse
gcaagcacaagacaagttgg

SEQ ID NO: 857909 - DNA, 20 bp, mouse
gtgcgcgtgcgcaggagccg

SEQ ID NO: 857910 - DNA, 20 bp, mouse
gtagtcacgaggaagcccag

SEQ ID NO: 857911 - DNA, 20 bp, mouse
gcgcgccacgcccacgccca

SEQ ID NO: 857912 - DNA, 20 bp, mouse
gacagggcaaatcaggtcgg

SEQ ID NO: 857913 - DNA, 20 bp, mouse
gcacgaggaagcccaggggc

SEQ ID NO: 857914 - DNA, 20 bp, mouse
ggcgtgggcgtggcgcgcga

SEQ ID NO: 857915 - DNA, 20 bp, mouse
gcagctcgagatgcgactct

SEQ ID NO: 857916 - DNA, 20 bp, mouse
gcgaacgccctcggcagcgt

SEQ ID NO: 857917 - DNA, 20 bp, mouse
gcggcctccgaggagtgaat

SEQ ID NO: 857918 - DNA, 20 bp, mouse
gctcggcagcgtgggtctca

SEQ ID NO: 857919 - DNA, 20 bp, mouse
gggagtgaataggagttggg

SEQ ID NO: 857920 - DNA, 20 bp, mouse
gcgtgctatgcgaacgccct

SEQ ID NO: 857921 - DNA, 20 bp, mouse
ggctggagagcgaggaccat

SEQ ID NO: 857922 - DNA, 20 bp, mouse
gccgaggagtgaataggagt

SEQ ID NO: 857923 - DNA, 20 bp, mouse
gcggacctgtgcgcggcgtg

SEQ ID NO: 857924 - DNA, 20 bp, mouse
gggggcggccattcaaacgc

SEQ ID NO: 857925 - DNA, 20 bp, mouse
ggcccccgccgcacgcccaa

SEQ ID NO: 857926 - DNA, 20 bp, mouse
ggacggggcggggtcttcag

SEQ ID NO: 857927 - DNA, 20 bp, mouse
ggggcggggcgagacatgca

SEQ ID NO: 857928 - DNA, 20 bp, mouse
gagaggggcgggacttctaa

SEQ ID NO: 857929 - DNA, 20 bp, mouse
gctaaggggcagggcgcggt

SEQ ID NO: 857930 - DNA, 20 bp, mouse
gaagggctggcgtttgagaa

SEQ ID NO: 857931 - DNA, 20 bp, mouse
gcgcggtaggctcagggaga

SEQ ID NO: 857932 - DNA, 20 bp, mouse
gggcgggaccactttggggc

SEQ ID NO: 857933 - DNA, 20 bp, mouse
ggcagggcgcggtaggctca

SEQ ID NO: 857934 - DNA, 20 bp, mouse
ggggccaacgccctctgacg

SEQ ID NO: 857935 - DNA, 20 bp, mouse
ggcgggacttctaaggggca

SEQ ID NO: 857936 - DNA, 20 bp, mouse
gcggggagggaggacccgac

SEQ ID NO: 857937 - DNA, 20 bp, mouse
gaaggagcggcccggagagg

SEQ ID NO: 857938 - DNA, 20 bp, mouse
gagggggcggggagagaccg

SEQ ID NO: 857939 - DNA, 20 bp, mouse
gaggacctgggccccttcct

SEQ ID NO: 857940 - DNA, 20 bp, mouse
ggggcggggagagaccgggg

SEQ ID NO: 857941 - DNA, 20 bp, mouse
gaggggcccaggtcctgccc

SEQ ID NO: 857942 - DNA, 20 bp, mouse
ggggacgtcgtgcacgggaa

SEQ ID NO: 857943 - DNA, 20 bp, mouse
ggcccagaccatacaaggag

SEQ ID NO: 857944 - DNA, 20 bp, mouse
gggagcccggggcaggacct

SEQ ID NO: 857945 - DNA, 20 bp, mouse
gcccgacaggaaactccccc

SEQ ID NO: 857946 - DNA, 20 bp, mouse
ggtgaagcgtggagcagaaa

SEQ ID NO: 857947 - DNA, 20 bp, mouse
gtcgcaacggagccgtcaag

SEQ ID NO: 857948 - DNA, 20 bp, mouse
gagacggatacgttaacggg

SEQ ID NO: 857949 - DNA, 20 bp, mouse
ggcgaggcctgatgtcgcaa

SEQ ID NO: 857950 - DNA, 20 bp, mouse
gggcggcagaggcggctaga

SEQ ID NO: 857951 - DNA, 20 bp, mouse
ggctagacggatacgttaac

SEQ ID NO: 857952 - DNA, 20 bp, mouse
gcccgcccgccaggagctgt

SEQ ID NO: 857953 - DNA, 20 bp, mouse
ggagacgccggccgtgacgt

SEQ ID NO: 857954 - DNA, 20 bp, mouse
gcgacagcttaatgaagccc

SEQ ID NO: 857955 - DNA, 20 bp, mouse
gcagcggcggcagtgacttc

SEQ ID NO: 857956 - DNA, 20 bp, mouse
gtcggcgcgccacctactgg

SEQ ID NO: 857957 - DNA, 20 bp, mouse
gcgctcggcgcgccacctac

SEQ ID NO: 857958 - DNA, 20 bp, mouse
gtcccagcgtctcagagccg

SEQ ID NO: 857959 - DNA, 20 bp, mouse
gggagccaacatggcggcgt

SEQ ID NO: 857960 - DNA, 20 bp, mouse
ggctgcgggaagtggaggag

SEQ ID NO: 857961 - DNA, 20 bp, mouse
ggcggggagcctctccggga

SEQ ID NO: 857962 - DNA, 20 bp, mouse
gcctctccgggaaggtagag

SEQ ID NO: 857963 - DNA, 20 bp, mouse
gaagagtcctgccctaggga

SEQ ID NO: 857964 - DNA, 20 bp, mouse
ggactcagaggaggaatcca

SEQ ID NO: 857965 - DNA, 20 bp, mouse
gccaggcaaggtcgggacgc

SEQ ID NO: 857966 - DNA, 20 bp, mouse
gaagagaaggggatgcactg

SEQ ID NO: 857967 - DNA, 20 bp, mouse
gggtgttgacatggaggtta

SEQ ID NO: 857968 - DNA, 20 bp, mouse
gaaagcaaaggggtaagatg

SEQ ID NO: 857969 - DNA, 20 bp, mouse
ggggacgagtctgaacctac

SEQ ID NO: 857970 - DNA, 20 bp, mouse
gaagactcgggagaaatata

SEQ ID NO: 857971 - DNA, 20 bp, mouse
gttgacatggaggttagggg

SEQ ID NO: 857972 - DNA, 20 bp, mouse
gtccctgggagagtctgggt

SEQ ID NO: 857973 - DNA, 20 bp, mouse
ggaaactaagccaactgggt

SEQ ID NO: 857974 - DNA, 20 bp, mouse
gctactgggctgaaagcaaa

SEQ ID NO: 857975 - DNA, 20 bp, mouse
gagcccacccagactctccc

SEQ ID NO: 857976 - DNA, 20 bp, mouse
gaaccaggggagcccagtgt

SEQ ID NO: 857977 - DNA, 20 bp, mouse
gaagaggaccagaggatcaa

SEQ ID NO: 857978 - DNA, 20 bp, mouse
gaggggagcccagtgtagga

SEQ ID NO: 857979 - DNA, 20 bp, mouse
gatgaacttgttcacgtctt

SEQ ID NO: 857980 - DNA, 20 bp, mouse
gggagcccagtgtaggacgg

SEQ ID NO: 857981 - DNA, 20 bp, mouse
gtgtcaggatgctgtaacca

SEQ ID NO: 857982 - DNA, 20 bp, mouse
gaaccagccctttgatcctc

SEQ ID NO: 857983 - DNA, 20 bp, mouse
ggggacagcttctgaaccag

SEQ ID NO: 857984 - DNA, 20 bp, mouse
gccttagcagggtttggcca

SEQ ID NO: 857985 - DNA, 20 bp, mouse
gatcttactgatggagcact

SEQ ID NO: 857986 - DNA, 20 bp, mouse
gtcccggctcgccctctggg

SEQ ID NO: 857987 - DNA, 20 bp, mouse
gcagtgcgccagcctcccag

SEQ ID NO: 857988 - DNA, 20 bp, mouse
gagcctcccagagggcgagc

SEQ ID NO: 857989 - DNA, 20 bp, mouse
gaggctggcgcactgcacta

SEQ ID NO: 857990 - DNA, 20 bp, mouse
gaggctgggtgaaacgattc

SEQ ID NO: 857991 - DNA, 20 bp, mouse
ggacccggaagtactcgttc

SEQ ID NO: 857992 - DNA, 20 bp, mouse
gtctccggaacgagtacttc

SEQ ID NO: 857993 - DNA, 20 bp, mouse
gtaaggtagtaaggaggagc

SEQ ID NO: 857994 - DNA, 20 bp, mouse
gggtgaaacgattctggcaa

SEQ ID NO: 857995 - DNA, 20 bp, mouse
gtcctccttactaccttaga
